United States Patent
Meinke et al.

(10) Patent No.: US 7,438,912 B2
(45) Date of Patent: Oct. 21, 2008

(54) S.AGALACTIAE ANTIGENS I + II

(75) Inventors: Andreas Meinke, Pressbaum (AT); Eszter Nagy, Vienna (AT); Markus Hanner, Vienna (AT); Markus Horky, Vienna (AT); Sabine Kallenda, Vienna (AT); Sonja Prustomersky, Vienna (AT)

(73) Assignee: Intercell AG, Vienna (AT)

( * ) Notice: Subject to any disclaimer, the term of this patent is extended or adjusted under 35 U.S.C. 154(b) by 0 days.

(21) Appl. No.: 10/556,060

(22) PCT Filed: May 6, 2004

(86) PCT No.: PCT/EP2004/004856

§ 371 (c)(1), (2), (4) Date: Nov. 7, 2005

(87) PCT Pub. No.: WO2004/099242

PCT Pub. Date: Nov. 18, 2004

(65) Prior Publication Data

US 2006/0269541 A1 Nov. 30, 2006

(30) Foreign Application Priority Data

May 7, 2003 (EP) ................... 03450112
Nov. 28, 2003 (EP) ................... 03450266

(51) Int. Cl.
*A61K 39/40* (2006.01)
*A61K 39/00* (2006.01)
*C07K 14/00* (2006.01)
*C07H 21/04* (2006.01)

(52) U.S. Cl. ............... 424/165.1; 424/184.1; 435/69.1; 435/252.3; 435/320.1; 435/325; 536/23.7; 530/300; 530/350

(58) Field of Classification Search ............. 435/252.3, 435/320.1, 325, 69.1; 536/23.7; 530/300, 530/350
See application file for complete search history.

(56) References Cited

FOREIGN PATENT DOCUMENTS

WO WO 02/059148 8/2002

OTHER PUBLICATIONS

Stalhammar-Carlemalm et al J.Exp.Med. 1993, 177, 1593-1603.*
Ellis, R.W. (Chapter 29 of "Vaccines" Plotkin, 5.A. et al. (eds) published by W. B. Saunders company (Philadelphia) in 1988.*
Accession nuber ABP28545.*
Accession No. ADV88412.*
Brodeur et al., "Identification of group B streptococcal Sip protein, which elicites cross-protective immunity," *Infection and Immunity*, 68:5610-5618, 2000.
Database EMBL accession No. AE14198.
Database EMBL accession No. AL766844.
Etz et al., "Identification of in vivo expressed vaccine candidate antigens from *Staphyolococcus aureus*," *Proc. Natl. Acad. Sci. USA*, 99:6573-6578, 2002.
Glaser et al., "Genome sequence of *Streptococcus agalactia*, a pathogen causing invasive neonatal disease," *Molecular Microbiology*, 45:1499-1513, 2002.
Henics et al., "Small-fragment genomic libraries for the display of putative epitopes from clinically significant pathogens," *Biotechniques*, 35:196-200,202,20, 2003.
Hughes et al., "Novel protein vaccine candidates against Group B streptococcal infection identified using alkaline phosphate fusions," *FEMS Microbiology Letters*, 222:263-271, 2003.
Klade, "Proteomics approaches towards antigen discovery in vaccine development," *Current Opinion in Molecular Therapeutics*, 4:216-224, 2002.
Larsson et al., "Protection against experimental infection with group B streptococcus by immunization with a bivalent protein vaccine," *Vaccine*, 17:454-458, 1999.
Michel et al., "Cloned alpha and beta C-protein antigens of group B Streptococci elicit protective immunity," *Infection and Immunity*, 59:2023-2028, 1991.
Moyo et al., "The putative R1 protein of streptococcus agalactiae as serotype marker and target of protective antibodies," *APMIS*, 109:842-848, 2001.
Tettelin et al., "Complete genome sequence and comparative genomic analysis of an emerging human pathogen, serotype V *Streptococcus agalactiae*," *Proc. Natl. Acad. Sci. USA*, 99:12391-12396, 2002.

* cited by examiner

*Primary Examiner*—Shanon A. Foley
*Assistant Examiner*—Padma V Baskar
(74) *Attorney, Agent, or Firm*—Fulbright & Jaworski LLP

(57) ABSTRACT

The present invention discloses isolated nucleic acid molecules encoding a hyperimmune serum reactive antigen or a fragment thereof as well as hyperimmune serum reactive antigens or fragments thereof from *S. agalactiae*, methods for isolating such antigens and specific uses thereof.

7 Claims, 8 Drawing Sheets

S. AGALACTIAE ANTIGENS I + II

CROSS-REFERENCE TO RELATED APPLICATIONS

This application is a national stage application under 35 U.S.C. §371 of International Application No. PCT/EP2004/004856 filed 6 May 2004, which claims priority to European Patent Application No. 03450112.2 filed 7 May 2003 and European Patent Application No. 03450266.6 filed 28 Nov. 2003. The entire text of each of the above-referenced disclosures is specifically incorporated by reference herein without disclaimer.

INCORPORATION BY REFERENCE OF SEQUENCE LISTING SUBMITTED ON A COMPACT DISC

The Sequence Listing is submitted on one compact disc (Copy 1), together with a duplicate thereof (Copy 2), each created on Nov. 7, 2005, and each containing one 1,161 kb file entitled "SONN080.APP.txt." The material contained on the compact disc is specifically incorporated herein by reference.

The present invention relates to isolated nucleic acid molecules, which encode antigens for Streptococcus agalactiae, which are suitable for use in preparation of pharmaceutical medicaments for the prevention and treatment of bacterial infections caused by Streptococcus agalactiae.

Streptococcus agalactiae is a gram-positive bacterium, and belongs to the Group B Streptococci (GBS) based on its hemolysis pattern in blood agar. The organism is encapsulated, and capsule is an important element of pathogenicity. Capsules are antigenic and form the basis for classifying GBS by serotypes. Nine distinct GBS serotypes have been identified: Ia, Ib, II, III, IV, V, VI, VII and VIII. Most S. agalactiae serotypes have been shown to cause serious disease, and the two most common serotypes—type III and V—are estimated to account for the majority of invasive disease worldwide. The ranking and serotype prevalence differs by age group and geographic area. In the US, GBS type III causes more than 50% of infant disease, type V about 40% of nonpregnant adult disease, and type Ia about a third of disease in any patient population.

Streptococcus agalactiae is an important agent of human disease at the extremities of age and in those who have underlying disease. Group B Streptococci are the major cause of generalized and focal infections in the newborn infant. GBS is the predominant pathogen in newborns in the US since the 1970's. Bacterial infection can lead to life threatening diseases, such as sepsis, pneumonia and meningitis. Survivors can become permanently handicapped with hearing, learning and visual disabilities. Newborns usually acquire the organism intrapartum or during delivery from their GBS-colonized mothers. In addition, GBS are also a frequent cause of infections in pregnant women and in chronically ill and elderly patients, such as those suffering from diabetes, malignancies, immunodeficiencies, etc., (reviewed by Balter, S. et al. in Gram positive pathogens ed. by Fischetti V. A. et al. ASM Press 2000, pp 154-160).

10-35% of pregnant women are colonized with GBS, but are asymptomatic. However, GBS colonization is important because of the risk of vertical transmission. 50-70% of neonates born to colonized women—that is 5-15% of all newborns—become colonized by GBS during delivery. Colonization is a prerequisite for infection and disease. The most preterm infants are at the highest risk for invasive disease due to low maternal transfer of antibodies and immature immune system. GBS carriage during pregnancy may be chronic, intermittent, or transient. It is difficult to assess the duration of carriage, since women are screened once during a prenatal visit from the late trimester. Several studies suggest that there is a correlation (~90%) between the colonization status in the third trimester and at the time of delivery. Serotyping of the isolates indicates that persistence of the same type is most common (reviewed by Balter, S. et al. in Gram positive pathogens ed. by Fischetti V. A. et al. ASM Press 2000, pp 154-160).

Without preventive intervention, 1 to 2% of all neonates and 15% of neonates born to heavily colonized women develop invasive disease (sepsis, pneumonia and/or meningitis). In the US, GBS infections affect 1-5 newborns/1000 live birth. About 17.000 cases of invasive GBS disease occurred in the US annually, and 7.500 occurred in newborns before prevention. GBS is the most common cause of bacterial meningitis accounting for ~40% of all cases reported in this age group. The overall incidence of invasive GBS disease is 0.2-0.7/100.000 in the US. It is somewhat lower in Europe. Mortality without preventive intervention is 6% with invasive disease, every 16. infected newborn dies and 20% of survivors become permanently handicapped.

The rates of serious group B strep infections are much higher among newborns than among any other age group. Nonetheless, serious group B strep infections occur in other age groups in both men and women. Among non-pregnant adults, rates of serious disease range from 4.1 to 7.2 cases per 100,000 populations. The average death rate for invasive infections (infections where the bacteria have entered a part of the body that is normally not exposed to bacteria) is 8-10% for adult's ages 18-64 and 15-25% for adults 65 years of age and over. Mortality rates are lower among younger adults, and adults who do not have other medical conditions. The rate of serious group B strep disease increases with age. The average age of cases in non-pregnant adults is about 60 years old. Most adult group B strep disease occurs in adults who have serious medical conditions. These include: diabetes mellitus; liver disease; history of stroke; history of cancer; or bedsores. Among the elderly, rates of serious group B strep disease are more common among residents of nursing facilities, and among bedridden hospitalized patients. Group B strep disease among non-pregnant adults may often be acquired after recent trauma, or after having certain invasive hospital procedures like surgery ({Farley, M., 2001}; {Jackson, L. et al., 1995}; www.cdc.gov/groupbstrep/).

Direct medical costs of neonatal disease before prevention were $294 million annually and GBS continues to pose a considerable economic burden.

A definitive diagnosis of infection with Streptococcus agalactiae generally relies on isolation of the organism from cervical swabs, blood or other normally sterile body sites. Tests are also available to detect capsular polysaccharide antigen in body fluids.

Penicillin G is the treatment of choice for established cases of GBS. Ten days of treatment is recommended for bacteremia, pneumonia and soft tissue infections, while 2-3 weeks is recommended for meningitis and 3-4 weeks for osteomyelitis.

Prevention has been established since 1994 in North America by screening pregnant women for carriage of GBS, taking vaginal and anorectal swabs at 35-37 weeks' gestation, or by identifying risk factors at admission for delivery without cultures. Women who are candidates for prophylaxis are given intrapartum antibiotic therapy during labor to prevent early-onset neonatal disease. This prevention method has decreased the incidence of GBS disease from 1.7 to 0.4/1000 live births between 1993 and 1999 in the US. Although most neonatal GBS disease can be prevented through intrapartum prophylaxis (Penicillin G or Ampicillin), currently available strategies are not ideal, especially for the prevention of late-onset (>7 days of age) infections and disease in premature babies. There are always individuals who escape of screening for carriage due to several reasons, such as intermittent carriers, who are tested negative at wks 32-35, but become positive during delivery, unattendance, negligence, or delivery before screening date (32-35 wks).

In the long run, widespread use of antibiotics usually induces resistant strains that appear after a period of time. Extensive use of Penicillin (every 3-5$^{th}$ women are treated with high dose), and other antibiotics has already been shown to steadily increase the percentage of antibiotic resistant clinical isolates (ref). Moreover, efficiency of antibiotic based prevention is not that effective for late onset disease, as it is for early onset (within 48 hrs after delivery). An additional concern is that prevention in susceptible adult populations has not been addressed.

Vaccine development is hindered by the lack of sufficient knowledge about the elements of protective immunity against GBS carriage and disease. The relationship of carriage to the development of natural immunity is poorly understood. In addition, the immunologic mechanism that allows disease to occur in a carrier is ill defined. However, it is suggested that the maternal serum levels of pathogen-specific antibodies are correlated with neonatal GBS disease. It has been firmly established that there is an inverse correlation between maternal anti-capsular polysaccharide antibody levels at delivery and the frequency of invasive neonatal diseases {Campbell, J. et al., 2000}.

Although the group B carbohydrate antigen is common to all strains of GBS, unfortunately, it is not strongly immunogenic and antibodies are not protective from lethal challenge in experimental models. The GBS capsule itself that is made of polysaccharides, is immunogenic and is able to induce protective antibodies. However, this protection is type-specific. Although capsular specific antibodies have been shown to be highly protective, it remains unclear what concentration of these serotype-specific antibodies protect against disease and more recently it has become clear that opsonic activity and avidity of these antibodies are more critical determinants of protection than concentration.

The importance of surface proteins in human immunity to *S. agalactiae* already has been appreciated. It is apparent that all serotypes express surface proteins with activity relevant to host immune defense. The alpha C protein, beta C protein, Rib and Sip proteins are well-characterized biochemically and genetically, and have also been shown to immunogenic and protective in animal models ({Michel, J. et al., 1991}; {Brodeur, B. et al., 2000}; {Larsson, C. et al., 1999}; {Cheng, Q. et al., 2002}). The major problem with these proteins as vaccine candidates seems to be their variability in prevalence among the different clinical isolates of GBS. The Rib protein for example is present in serotype III GBS, but missing from type V, which responsible for significant portion of disease worldwide. Some other surface proteins are characterized as being immunogenic, but there is a limited systematic work done to identify most of the immunogenic proteins of GBS.

Thus, there remains a need for an effective treatment to prevent or ameliorate GBS infections. A vaccine could not only prevent infections by GBS, but more specifically prevent or ameliorate colonization of host tissues (esp. in the birth canal), thereby reducing the incidence of transmission from mother to fetus. Reducing the incidence of acute infection and carriage of the organism would lead to prevention of invasive diseases in newborns—pneumonia, bacteremia, meningitis, and sepsis. Vaccines capable of showing cross-protection against the majority of *S. agalactiae* strains causing human infections could also be useful to prevent or ameliorate infections caused by all other streptococcal species, namely groups A, C and G.

A vaccine can contain a whole variety of different antigens. Examples of antigens are whole-killed or attenuated organisms, subfractions of these organisms/tissues, proteins, or, in their most simple form, peptides. Antigens can also be recognized by the immune system in form of glycosylated proteins or peptides and may also be or contain polysaccharides or lipids. Short peptides can be used since for example cytotoxic T-cells (CTL) recognize antigens in form of short usually 8-11 amino acids long peptides in conjunction with major histocompatibility complex (MHC). B-cells can recognize linear epitopes as short as 4-5 amino acids, as well as three-dimensional structures (conformational epitopes). In order to obtain sustained, antigen-specific immune responses, adjuvants need to trigger immune cascades that involve all cells of the immune system. Primarily, adjuvants are acting, but are not restricted in their mode of action, on so-called antigen presenting cells (APCs). These cells usually first encounter the antigen(s) followed by presentation of processed or unmodified antigen to immune effector cells. Intermediate cell types may also be involved. Only effector cells with the appropriate specificity are activated in a productive immune response. The adjuvant may also locally retain antigens and co-injected other factors. In addition the adjuvant may act as a chemoattractant for other immune cells or may act locally and/or systemically as a stimulating agent for the immune system.

Vaccine development since the late 1970s has focused on the capsular polysaccharides, but a safe, effective product is still not available. However, vaccine against *S. agalactiae* is ranked as one of the most important for development and administration to infants and high-risk adults. Currently vaccines against this infection are only in the research stages of development. Efforts are focused on using capsular polysaccharide (CPS) as immunogens, either with or without conjugation to protein {Paoletti, L. et al., 2002}. However, there are several arguments against the use of polysaccharide-based vaccine. Polysaccharides induce IgG2 antibodies, which cross the placenta less efficiently then IgG1 or IgG3 antibodies. It is especially a problem for the most susceptible neonates, the still-borns since placental antibody transfer is low before weeks 32-34. It is estimated that ~10% of deliveries occur before the 34$^{th}$ pregnancy week.

Protein conjugate vaccines are no doubt a great new addition to the amarmatorium in the battle against GBS disease, but the vaccine can contain only a limited number of GBS serotypes and given adequate ecological pressure, replacement disease by non-vaccine serotypes remains a real threat, particularly in areas with very high disease burden. Moreover, polysaccharide antigens used for active immunization do not provide immunological memory in humans. Conjugation of CPS to non-GBS related immunogenic protein carriers (e.g. tetanus toxoid, cholera toxin B subunit, etc.) has been shown to beneficial in inducing higher concentrations of antibodies in vaccinees, but it does not provide pathogen-specific B cell and T cell epitopes which would recruit memory B and T cells during a real infection to support the most effective host response. To be able to supplement the CPS vaccines with proteins fulfilling these criteria it is necessary to identify conserved immunogenic GBS-specific surface proteins.

All these insufficiencies suggest that there is a need to develop new generation vaccines composed of proteins, or their derivatives, expressed by all strains under in vivo conditions with the ability to induce opsonizing and/or neutralizing antibodies in humans.

There is a great potential for passive antibody-based therapy. There have been already attempts to use human intravenous immunoglobulin (IVIG) preparations for prevention. Recent advances in the technology of monoclonal antibody production provide the means to generate human antibody reagents and reintroduce antibody therapies, while avoiding the toxicities associated with serum therapy. Immunoglobulins are an extremely versatile class of antimicrobial proteins that can be used to prevent and treat emerging infectious diseases. Antibody therapy has been effective against a variety of diverse microorganisms (reviewed in {Burnie, J. et al., 1998}). Anti-GBS mAbs could be given therapeutically to every newborn that develop invasive diseases or preventively to low birth-weight and premature neonates.

During the last decade the immunogenicity and protective capacity of several GBS proteins have been described in animal models and these are now being explored for the development of species-common protein based vaccines. Such proteins are the GBS surface proteins Sip {Brodeur, B. et al., 2000}, rib, ●-protein and {Michel, J. et al., 1991}.

Certain proteins or enzymes displayed on the surface of gram-positive organisms significantly contribute to pathogenesis, are involved in the disease process caused by these pathogens. Often, these proteins are involved in direct interactions with host tissues or in concealing the bacterial surface from the host defense mechanisms {Navarre, W. et al., 1999}. *S. agalactiae* is not an exception in this regard. Several surface proteins are characterized as virulence factors, important for GBS pathogenicity ((reviewed in (Paoletti L. C. et al. in Gram positive pathogens, ed. by Fischetti V. A et al., ASM Press 2000, pp 137-153); {Paoletti, L. et al., 2002}). If antibodies to these proteins could offer better protection to humans then polysaccharides, they could provide the source of a novel, protein-based GBS vaccine to be used in conjunction with or in place of the more traditional capsular polysaccharide vaccine. The use of some of the above-described proteins as antigens for a potential vaccine as well as a number of additional candidates resulted mainly from a selection based on easiness of identification or chance of availability. There is a demand to identify relevant antigens for *S. agalactiae* in a more comprehensive way.

The present inventors have developed a method for identification, isolation and production of hyperimmune serum reactive antigens from a specific pathogen, especially from *Staphylococcus aureus* and *Staphylococcus epidermidis* (WO 02/059148). However, given the differences in biological property, pathogenic function and genetic background, *Streptococcus agalactiae* is distinctive from *Staphylococcus* strains. Importantly, the selection of sera for the identification of antigens from *S. agalactiae* is different from that applied to the *S. aureus* screens. Four major types of human antibody sources were collected for that purpose. First, healthy pregnant women who were tested negative for cervical and anorectal carriage of GBS. This donor group represents the most important source of antibodies. In addition to their serum samples, human cervical secretions collected with cervical wicks, containing secretory IgA (sIgA) were also used for antigen identification and validation. The main value of this collection is that sIgA can be considered the major immune effector molecule on mucosal surfaces. Second, healthy pregnant women colonized with GBS whose newborn remained GBS-free (although with antibiotic prevention). Third, adults below <45 years of age without clinical disease. Four, naïve individuals, young children between 5 and 10 months of age, after they already lost maternal antibodies and have not acquired GBS-specific ones due to the lack of GBS disease.

To be able to select for relevant serum sources, a series of ELISAs and immunoblotting experiments measuring anti-*S. agalactiae* IgG and IgA antibody levels were performed with bacterial lysates and culture supernatant proteins. Sera from high titer carriers and non-carriers were included in the genomic-based antigen identification. This approach for selection of human sera is basically very different from that used for *S. aureus*, where carriage or non-carriage state couldn't be associated with antibody levels.

The present invention uses high throughput genomic method to identify in vivo expressed pathogen-specific proteins with the ability to induce antibodies in humans during the course of infections and colonization.

The genomes of the two bacterial species *S. agalactiae* and *S. aureus* by itself show a number of important differences. The genome of *S. agalactiae* contains app. 2.2 Mb, while *S. aureus* harbors 2.85 Mb. They have an average GC content of 35.7 and 33%, respectively and approximately 30 to 45% of the encoded genes are not shared between the two pathogens. In addition, the two bacterial species require different growth conditions and media for propagation. A list of the most important diseases, which can be inflicted by the two pathogens is presented below. *S. aureus* causes mainly nosocomial, opportunistic infections: impetigo, folliculitis, abscesses, boils, infected lacerations, endocarditis, meningitis, septic arthritis, pneumonia, osteomyelitis, scalded skin syndrome (SSS), toxic shock syndrome. *S. agalactiae* causes mainly neonatal infections and diseases in elderly, such as bacteremia, sepsis, wound infection, osteomyelitis and meningitis.

The complete genome sequence of a capsular serotype III isolate of *S. agalactiae*, designated NEM316 (ATCC 12403) was determined by the random shotgun sequencing strategy (GenBank accession number AL732656; see www.tigr.org/tigrscripts/CMR2/CMRHomePage.spl). {Glaser, P. et al., 2002}.

The problem underlying the present invention was to provide means for the development of medicaments such as vaccines against *S. agalactiae* infection. More particularly, the problem was to provide an efficient, relevant and comprehensive set of nucleic acid molecules or hyperimmune serum reactive antigens from *S. agalactiae* that can be used for the manufacture of said medicaments.

Therefore, the present invention provides an isolated nucleic acid molecule encoding a hyperimmune serum reactive antigen or a fragment thereof comprising a nucleic acid sequence, which is selected from the group consisting of:
  a) a nucleic acid molecule having at least 70% sequence identity to a nucleic acid molecule selected from Seq ID No 14, 90, 157-216.
  b) a nucleic acid molecule which is complementary to the nucleic acid molecule of a),
  c) a nucleic acid molecule comprising at least 15 sequential bases of the nucleic acid molecule of a) or b)
  d) a nucleic acid molecule which anneals under stringent hybridisation conditions to the nucleic acid molecule of a), b), or c)
  e) a nucleic acid molecule which, but for the degeneracy of the genetic code, would hybridize to the nucleic acid molecule defined in a), b), c) or d).

According to a preferred embodiment of the present invention the sequence identity is at least 80%, preferably at least 95%, especially 100%.

Furthermore, the present invention provides an isolated nucleic acid molecule encoding a hyperimmune serum reactive antigen or a fragment thereof comprising a nucleic acid sequence selected from the group consisting of
  a) a nucleic acid molecule having 96% or more than 96%, preferably at least 98%, especially 100% sequence identity to a nucleic acid molecule selected from Seq ID No 1, 3, 5-13, 15, 18-25, 27-31, 33-36, 39-68, 70-85, 92-100, 103-126, 128-145, 147, 149-156, 217, 435-448 and 463-474.
  b) a nucleic acid molecule which is complementary to the nucleic acid molecule of a),
  c) a nucleic acid molecule comprising at least 15 sequential bases of the nucleic acid molecule of a) or b)
  d) a nucleic acid molecule which anneals under stringent hybridisation conditions to the nucleic acid molecule of a), b) or c),
  e) a nucleic acid molecule which, but for the degeneracy of the genetic code, would hybridize to the nucleic acid defined in a), b), c) or d).

According to another aspect, the present invention provides an isolated nucleic acid molecule encoding a hyperimmune serum reactive antigen or a fragment thereof comprising a nucleic acid sequence selected from the group consisting of
  a) a nucleic acid molecule having 98% or more than 98%, especially 100% sequence identity to a nucleic acid molecule selected from Seq ID No 32, 86, 91, 101, 127.
  b) a nucleic acid molecule which is complementary to the nucleic acid of a),
  c) a nucleic acid molecule which, but for the degeneracy of the genetic code, would hybridize to the nucleic acid defined in a), b), c) or d).

Preferably, the nucleic acid molecule is DNA or RNA.

According to a preferred embodiment of the present invention, the nucleic acid molecule is isolated from a genomic DNA, especially from a S. agalactiae genomic DNA.

According to the present invention a vector comprising a nucleic acid molecule according to any of the present invention is provided.

In a preferred embodiment the vector is adapted for recombinant expression of the hyperimmune serum reactive antigens or fragments thereof encoded by the nucleic acid molecule according to the present invention.

The present invention also provides a host cell comprising the vector according to the present invention. According to another aspect the present invention further provides a hyperimmune serum-reactive antigen comprising an amino acid sequence being encoded by a nucleic acid molecule according to the present invention.

In a preferred embodiment the amino acid sequence (polypeptide) is selected from the group consisting of Seq ID No 231, 307, 374-433.

In another preferred embodiment the amino acid sequence (polypeptide) is selected from the group consisting of Seq ID No 218, 220, 222-230, 232, 235-242, 244-248, 250-253, 256-285, 287-302, 309-317, 320-343, 345-362, 364, 366-373, 434, 449-462 and 475-486.

In a further preferred embodiment the amino acid sequence (polypeptide) is selected from the group consisting of Seq ID No 249, 303, 308, 318, 344.

According to a further aspect the present invention provides fragments of hyperimmune serum-reactive antigens selected from the group consisting of peptides comprising amino acid sequences of column "predicted immunogenic aa" and "location of identified immunogenic region" of Table 1A, especially peptides comprising amino acid 4-20, 35-44, 65-70, 73-87, 92-98, 112-137, 152-161, 177-186, 193-200, 206-213, 229-255, 282-294, 308-313, 320-326, 349-355, 373-384, 388-406, 420-425 and 115-199 of Seq ID No 218; 5-24, 35-41, 44-70, 73-89, 103-109, 127-143, 155-161, 185-190, 192-207, 212-219, 246-262, 304-336, 372-382, 384-393, 398-407, 412-418, 438-444, 1-75, 76-161 and 164-239 of Seq ID No 219; 4-10, 16-58, 60-71, 77-92, 100-126, 132-146, 149-164, 166-172, 190-209, 214-220, 223-229, 241-256, 297-312, 314-319, 337-343, 351-359, 378-387, 398-418, 421-428, 430-437, 440-448, 462-471, 510-519, 525-536, 552-559, 561-568, 573-582, 596-602, 608-630, 637-649, 651-665, 681-702, 714-732, 739-745, 757-778, 790-805, 807-815, 821-829, 836-842, 846-873, 880-903, 908-914, 916-923, 931-940, 943-948, 956-970, 975-986, 996-1015, 1031-1040, 1051-1069, 1072-1095, 1114-1119, 1130-1148, 1150-1157, 1169-1176, 1229-1238 and 802-812 of Seq ID No 220; 5-12, 14-26, 35-47, 52-67, 72-78, 83-98, 121-141, 152-159, 163-183, 186-207, 209-257, 264-277, 282-299, 301-309, 312-318, 324-339, 358-368, 372-378, 387-397, 425-431 and 46-291 of Seq ID No 221; 29-38, 44-64, 70-76, 78-87, 94-100, 102-112, 119-134, 140-149, 163-173, 178-186, 188-194, 207-234, 247-262, 269-290 and 73-92 of Seq ID No 222; 10-28, 36-63, 77-87, 103-119, 127-136, 141-169, 171-183, 195-200, 207-232, 236-246, 251-265, 268-283, 287-297, 314-322, 335-343, 354-363, 384-390, 405-411, 419-436, 443-455, 467-473, 480-513, 518-529, 550-557, 565-585, 602-608, 616-625, 632-660, 665-677, 685-701, 726-736, 738-747, 752-761, 785-796, 801-813, 838-853, 866-871 and 757-774 of Seq ID No 223; 31-38, 61-66, 74-81, 90-115, 123-145, 154-167, 169-179, 182-193, 200-206, 238-244, 267-272 and 235-251 of Seq ID No 224; 19-25, 38-54, 56-64, 66-72, 74-92, 94-100, 116-129, 143-149, 156-183, 204-232, 253-266, 269-275, 294-307 and 241-313 of Seq ID No 225; 5-34, 50-56, 60-65, 74-85, 89-97, 108-119, 159-165, 181-199, 209-225, 230-240, 245-251, 257-262, 274-282, 300-305 and 64-75 of Seq ID No 226; 5-13, 16-21, 27-42, 45-52, 58-66, 74-87, 108-114, 119-131 and 39-51 of Seq ID No 227; 6-23, 46-54, 59-65, 78-84, 100-120, 128-133, 140-146, 159-165, 171-183, 190-204, 224-232, 240-248, 250-259, 274-280, 288-296, 306-315 and 267-274 of Seq ID No 228; 5-12, 15-24, 26-36, 42-65, 68-80, 82-104, 111-116, 125-144, 159-167, 184-189, 209-218, 235-243, 254-265, 269-283, 287-300, 306-316, 318-336, 338-352, 374-392 and 162-174 of Seq ID No 229; 30-42, 45-54 and 25-37 of Seq ID No 230; 10-30, 53-59, 86-95, 116-130, 132-147, 169-189, 195-201, 212-221, 247-256, 258-265, 278-283, 291-298, 310-316, 329-339, 341-352, 360-367, 388-396, 398-411, 416-432, 443-452, 460-466, 506-512, 515-521, 542-548 and 419-431 of Seq ID No 231; 4-27, 30-53, 60-67, 70-90, 92-151, 159-185, 189-195, 198-210, 215-239 and 173-189 of Seq ID No 232; 4-26, 41-54, 71-78, 116-127, 140-149, 151-158, 161-175, 190-196, 201-208, 220-226, 240-252, 266-281, 298-305, 308-318, 321-329, 344-353, 372-378, 384-405, 418-426, 429-442, 457-463, 494-505, 514-522 and 174-188 of Seq ID No 233; 17-25, 27-39, 61-67, 81-89, 99-110, 120-131, 133-139, 147-161, 167-172, 179-185, 192-198, 203-213, 226-238, 243-258, 261-267, 284-290, 296-307, 311-328, 340-352, 356-371 and 239-256 of Seq ID No 234; 8-30, 40-49, 67-80, 114-123, 126-142, 152-162, 188-194 and 57-70 of Seq ID No 235; 4-23, 28-34, 36-47, 50-61, 76-81, 89-94, 96-104, 112-119, 126-146, 155-181, 195-200, 208-214, 220-229, 244-260, 263-276, 282-288, 292-300, 317-323, 336-351, 353-359, 363-375, 382-399, 415-432, 444-455, 458-471, 476-481, 484-492, 499-517, 522-529, 535-541, 543-568, 572-584, 586-600, 607-617, 626-637, 656-675 and 282-297 of Seq ID No 236; 6-24, 30-35, 38-45, 63-91, 134-140, 146-160, 167-188, 214-220, 226-234, 244-250, 260-270, 286-301, 316-329, 340-371, 429-446, 448-459, 474-481, 485-491, 512-526, 537-544, 550-565, 573-583, 596-613, 621-630, 652-658 and 87-97 of Seq ID No 237; 8-20, 26-48, 56-67, 76-86, 94-109, 115-121, 123-129, 143-160, 178-186, 191-198, 201-208, 221-236, 238-244, 260-268 and 237-247 of Seq ID No 238; 4-40, 42-57, 73-87, 98-117, 126-135, 150-156, 166-174, 196-217, 231-236, 248-258, 276-284, 293-301, 307-313, 339-347, 359-365, 375-387, 395-402, 428-440, 445-456, 485-490, 497-505, 535-541, 547-555, 610-625, 648-656, 665-671 and 448-528 of Seq ID No 239; 10-18, 39-45, 51-61, 80-96, 98-106, 110-115, 158-172, 174-183, 191-200, 220-237, 249-255, 274-289, 308-324, 331-341, 372-381, 384-397, 405-414 and 322-338 of Seq ID No 240; 30-36, 38-56, 85-108, 134-147, 149-160, 163-183, 188-201, 206-211, 219-238, 247-254 and 5-13 of Seq ID No 241; 11-40, 98-103, 110-115, 133-145, 151-159, 172-179, 192-201, 204-212, 222-228, 235-245, 258-268, 283-296, 298-309, 322-329, 342-351, 354-362, 372-378, 385-393, 407-418, 495-516 and 1-148 of Seq ID No 242; 5-19, 21-36, 73-94, 112-119, 122-137, 139-145, 152-167, 184-190, 198-204, 208-224, 249-265, 267-281, 299-304, 309-317, 326-333, 356-364, 368-374, 381-389, 391-414, 419-425, 430-435 and 113-140 of Seq ID No 243; 45-54, 59-67, 78-91 and 15-23 of Seq ID No 244; 11-22, 33-47, 52-80, 88-112, 124-129 and 6-25 of Seq ID No 245; 26-41, 51-63, 80-89, 93-115, 150-163, 187-193, 220-237, 240-249, 286-294, 296-306, 316-329, 345-353, 361-370, 407-425, 428-437, 474-482, 484-494, 504-517, 533-541, 549-558, 595-613, 616-625, 660-668, 673-685, 711-726, 736-744, 749-761, 787-802, 812-820, 825-837, 863-878, 888-896, 901-913, 939-954, 964-972, 977-989, 1003-1008, 1016-1022, 1028-1034, 1041-1053, 1059-1074, 1101-1122, 420-511 and 581-704 of Seq ID No 246; 18-25, 27-55, 71-83, 89-95, 102-113, 120-146, 150-156, 174-185 and 159-175 of Seq ID No 247; 24-30, 38-56, 63-68, 87-93, 136-142, 153-164, 183-199, 213-219, 226-234, 244-261, 269-278, 283-289, 291-297, 320-328, 330-336, 340-346, 348-356, 358-366, 382-387, 401-408, 414-419, 449-455, 468-491, 504-512, 531-537, 554-560, 597-608, 621-627, 632-643, 650-662, 667-692, 703-716, 724-737, 743-758, 783-794, 800-818, 846-856 and 806-884 of Seq ID No 248; 4-14, 21-39, 86-92, 99-107, 121-131, 136-144, 147-154, 158-166, 176-185, 193-199, 207-222, 224-230 and 117-136 of Seq ID No 249; 65-76, 85-97, 103-109, 115-121, 125-146, 163-169, 196-205, 212-219, 228-237, 241-247, 254-262, 269-288, 294-303, 305-313, 328-367, 395-401, 405-412, 418-429, 437-447, 481-488, 506-513, 519-524, 530-541, 546-557 and 266-284 of Seq ID No 250; 5-14, 37-42, 49-71, 78-92, 97-112, 127-136, 147-154, 156-163, 186-198, 216-225, 233-243, 248-253, 295-307, 323-332, 359-366, 368-374, 380-398 and 194-223 of Seq ID No 251; 4-11, 33-39, 45-72, 100-113, 119-129, 136-144, 169-175, 177-185, 200-208, 210-219, 262-276, 278-297, 320-326, 336-344, 347-362, 381-394, 443-453 and 438-454 of Seq ID No 252; 4-29, 31-52, 55-61, 95-110, 138-158, 162-171, 179-187, 202-229, 239-248, 251-256, 262-267, 269-285, 304-310, 351-360, 362-368, 381-388, 415-428, 435-440, 448-458 and 161-178 of Seq ID No 253; 4-17, 19-28, 32-43, 47-59, 89-110, 112-126, 128-134, 140-148, 152-161, 169-184, 191-204, 230-235, 255-264, 328-338, 341-347, 401-409, 413-419, 433-441, 449-458, 463-468, 476-482, 486-492, 500-506, 529-545 and 305-381 of Seq ID No 254; 10-29, 38-45, 53-61, 134-145, 152-160, 163-170, 202-208, 219-229, 248-258, 266-275, 282-288, 315-320, 328-334, 377-385, 392-402, 418-424, 447-453, 460-471, 479-487, 491-497, 500-507, 531-537, 581-594, 615-623, 629-635, 644-652, 659-666, 668-678, 710-717, 719-728, 736-741, 747-760, 766-773, 784-789, 794-800, 805-817, 855-861, 866-887 and 698-715 of Seq ID No 255; 16-26, 29-37, 44-58, 62-68, 74-80, 88-95, 97-120, 125-144, 165-196 and 58-72 of Seq ID No 256; 14-21, 23-46, 49-60, 63-74, 78-92, 96-103, 117-129, 134-161, 169-211, 217-231, 239-248, 252-281, 292-299, 313-343 and 243-257 of Seq ID No 257; 11-27, 46-52, 67-72, 76-84, 91-112, 116-153, 160-175, 187-196, 202-211, 213-220 and 43-76 of Seq ID No 258; 5-29, 37-56, 78-86, 108-118, 152-161 and 120-130 of Seq ID No 259; 8-14, 19-41, 52-66, 75-82, 87-92, 106-121, 127-133, 136-143, 158-175, 180-187, 196-204, 221-228, 239-245, 259-265, 291-306, 318-323, 328-340, 352-358, 361-368, 375-381, 391-399, 411-418, 431-442, 446-455, 484-496, 498-510, 527-533, 541-549, 558-565, 575-585, 587-594, 644-655, 661-668, 671-677 and 184-196 of Seq ID No 260; 4-22, 29-38, 55-62, 75-81, 102-107, 110-134, 143-150, 161-167, 172-179, 191-215, 223-233, 241-247, 251-264, 266-272, 288-309, 340-352, 354-366, 394-402, 414-438 and 198-218 of Seq ID No 261; 24-44, 49-70, 80-91, 105-118, 128-136, 140-154 and 77-92 of Seq ID No 262; 5-22, 31-36, 41-47, 67-74, 83-90, 105-122, 135-143, 160-167 and 118-129 of Seq ID No 263; 4-25, 33-73, 81-93, 96-106, 114-120, 122-128, 130-172, 179-208, 210-241, 251-283, 296-301 and 92-100 of Seq ID No 264; 14-24, 29-38, 43-50, 52-72, 86-97, 101-107, 110-125, 127-141, 145-157, 168-175, 177-184, 186-195, 205-226, 238-250, 255-261, 284-290, 293-304, 307-314, 316-323, 325-356, 363-371, 383-390, 405-415, 423-432, 442-454, 466-485, 502-511, 519-527, 535-556, 558-565, 569-574, 612-634, 641-655, 672-686, 698-709, 715-722, 724-732, 743-753, 760-769, 783-792, 818-825, 830-839, 842-849, 884-896, 905-918, 926-940, 957-969, 979-1007, 1015-1021, 1049-1057 and 336-349 of Seq ID No 265; 6-16, 26-31, 33-39, 62-73, 75-85, 87-100, 113-123, 127-152, 157-164, 168-181, 191-198, 208-214, 219-226, 233-254, 259-266, 286-329 and 181-195 of Seq ID No 266; 4-13, 32-39, 53-76, 99-108, 110-116, 124-135, 137-146, 149-157, 162-174, 182-190, 207-231, 242-253, 255-264, 274-283, 291-323, 334-345, 351-360, 375-388, 418-425, 456-474, 486-492, 508-517, 520-536, 547-560, 562-577, 31-45 and 419-443 of Seq ID No 267; 15-26, 30-37, 42-49, 58-90, 93-99, 128-134, 147-154, 174-179, 190-197, 199-205, 221-230, 262-274, 277-287, 300-314, 327-333, 343-351, 359-377, 388-396, 408-413, 416-425, 431-446 and 246-256 of Seq ID No 268; 5-26, 34-42, 47-54, 61-67, 71-104, 107-115, 131-138, 144-153, 157-189, 196-202, 204-210, 228-245, 288-309, 316-329, 332-341, 379-386, 393-399, 404-412, 414-421, 457-468, 483-489, 500-506, 508-517, 523-534, 543-557, 565-580, 587-605, 609-617, 619-627, 631-636, 640-646, 662-668, 675-682, 705-710, 716-723, 727-732, 750-758, 784-789, 795-809, 869-874, 14-138, 166-286, 372-503, 674-696 and 754-859 of Seq ID No 269; 5-17, 32-38, 40-47, 80-89, 113-119, 125-137, 140-154, 157-163, 170-177, 185-199, 213-225, 228-236, 242-248, 277-290, 292-305, 323-333, 347-353, 364-370, 385-394, 399-406, 423-433, 441-451, 462-474, 477-487 and 116-124 of Seq ID No 270; 7-16, 18-30, 32-49, 53-61, 63-85, 95-101, 105-115, 119-134, 143-150, 159-178, 185-202, 212-229, 236-250, 254-265, 268-294 and 63-72 of Seq ID No 271; 4-12, 19-47, 73-81, 97-103, 153-169, 188-198, 207-213, 217-223, 236-242, 255-265, 270-278, 298-305, 309-317, 335-347, 354-363, 373-394, 419-424, 442-465, 486-492, 500-507, 542-549, 551-558, 560-572, 580-589, 607-614, 617-623, 647-653, 666-676, 694-704, 706-714, 748-754, 765-772, 786-792, 795-806 and 358-370 of Seq ID No 272; 18-28, 30-38, 40-46, 49-55, 69-78, 82-98, 104-134, 147-153, 180-190, 196-202, 218-236, 244-261, 266-273, 275-286, 290-295, 301-314, 378-387, 390-395, 427-434 and 290-305 of Seq ID No 273; 4-13, 20-31, 39-51, 54-61, 69-84, 87-105, 117-124 and 108-125 of Seq ID No 274; 24-34, 43-54, 56-66, 68-79 and 50-69 of Seq ID No 275; 5-43, 71-77, 102-131, 141-148, 150-156, 159-

186, 191-207, 209-234, 255-268, 280-286, 293-299, 317-323, 350-357, 363-372, 391-397, 406-418, 428-435, 455-465, 484-497, 499-505, 525-531, 575-582, 593-607, 621-633, 638-649, 655-673, 684-698, 711-725, 736-741, 743-752, 759-769, 781-793, 813-831, 843-853, 894-905, 908-916, 929-946, 953-963, 970-978, 1001-1007, 1011-1033, 165-178 and 818-974 of Seq ID No 276; 16-44, 63-86, 98-108, 185-191, 222-237, 261-274, 282-294, 335-345, 349-362, 374-384, 409-420, 424-430, 440-447, 453-460, 465-473, 475-504, 522-534, 538-551, 554-560, 567-582, 598-607, 611-619, 627-640, 643-653, 655-661, 669-680, 684-690, 701-707, 715-731, 744-750, 756-763, 768-804, 829-837, 845-853, 855-879, 884-890, 910-928, 77-90, 144-212, 279-355, 434-536, 782-810 and 875-902 of Seq ID No 277; 4-22, 29-41, 45-51, 53-66, 70-77, 86-95, 98-104, 106-124, 129-135, 142-151, 153-161, 169-176, 228-251, 284-299, 331-337, 339-370, 380-387, 393-398, 406-411, 423-433, 440-452, 461-469, 488-498, 501-516, 523-530, 532-559, 562-567, 570-602, 612-628, 630-645, 649-659, 666-672, 677-696, 714-723, 727-747 and 212-227 of Seq ID No 278; 4-9, 17-31, 35-41, 56-61, 66-75, 81-87, 90-124, 133-138, 149-163, 173-192, 213-219, 221-262, 265-275, 277-282, 292-298, 301-307, 333-346, 353-363, 371-378, 419-430, 435-448, 456-469, 551-570, 583-599, 603-612 and 275-291 of Seq ID No 279; 28-34, 53-58, 72-81, 100-128, 145-154, 159-168, 172-189, 217-225, 227-249, 256-263, 299-309, 322-330, 361-379, 381-388, 392-401, 404-417, 425-436, 440-446, 451-464, 469-487, 502-511, 543-551, 559-564, 595-601, 606-612, 615-626, 633-642, 644-650, 664-670, 674-684, 692-701, 715-723, 726-734, 749-756, 763-771, 781-787, 810-843, 860-869, 882-889, 907-917, 931-936, 941-948, 951-958, 964-971, 976-993, 1039-1049, 1051-1065, 1092-1121, 1126-1132, 1145-1151, 1158-1173, 1181-1192, 1194-1208, 1218-1223, 1229-1243, 1249-1254, 1265-1279, 1287-1297, 1303-1320, 1334-1341, 1343-1358, 1372-1382, 1406-1417, 1419-1425, 1428-1434, 1441-1448, 1460-1473, 1494-1504, 1509-1514, 1529-1550, 654-669 and 1400-1483 of Seq ID No 280; 10-16, 20-25, 58-65, 97-109, 118-132, 134-146, 148-155, 186-195, 226-233, 244-262, 275-284, 295-310, 317-322, 330-339, 345-351, 366-375, 392-403, 408-415, 423-430, 435-444, 446-457, 467-479, 486-499, 503-510, 525-537, 540-585, 602-612, 614-623, 625-634, 639-645, 650-669, 700-707, 717-724, 727-739, 205-230 and 733-754 of Seq ID No 281; 5-22, 37-43, 72-81, 105-113, 128-133, 148-160, 188-194, 204-230, 238-245, 251-257 and 194-213 of Seq ID No 282; 16-21, 35-41, 56-72, 74-92, 103-109 and 62-68 of Seq ID No 283; 4-15, 17-82, 90-104, 107-159, 163-170, 188-221, 234-245, 252-265 and 220-235 of Seq ID No 284; 16-22, 36-46, 61-75, 92-107, 113-121, 139-145, 148-160 and 30-42 of Seq ID No 285; 4-12, 20-26, 43-49, 55-62, 66-78, 121-127, 135-141, 146-161, 164-170, 178-189, 196-205, 233-238, 269-279, 288-318, 325-332, 381-386, 400-407 and 328-346 of Seq ID No 286; 5-12, 31-49, 57-63, 69-79, 89-97, 99-114, 116-127, 134-142, 147-154, 160-173, 185-193, 199-204, 211-222, 229-236, 243-249, 256-274 and 58-68 of Seq ID No 287; 10-20, 28-34, 39-53, 68-79, 84-90, 99-106 and 73-79 of Seq ID No 288; 14-37, 45-50, 61-66, 77-82, 93-98, 109-114, 125-130, 141-146, 157-162, 173-178, 189-194, 205-210, 221-226, 237-242, 253-258, 269-274, 285-290, 301-306, 316-332, 349-359, 371-378, 385-406, 34-307 and 312-385 of Seq ID No 289; 4-10, 17-38, 50-85, 93-99, 109-116, 128-185, 189-197, 199-210, 223-256, 263-287, 289-312, 327-337, 371-386, 389-394, 406-419, 424-432, 438-450, 458-463, 475-502, 507-513, 519-526, 535-542, 550-567 and 361-376 of Seq ID No 290; 10-39, 42-93, 100-144, 155-176, 178-224, 230-244, 246-255, 273-282, 292-301, 308-325, 332-351, 356-361, 368-379, 386-393, 400-421 and 138-155 of Seq ID No 291; 5-11, 17-34, 40-45, 50-55, 72-80, 101-123, 145-151, 164-172, 182-187, 189-195, 208-218, 220-241, 243-252, 255-270, 325-331, 365-371, 391-398, 402-418, 422-428, 430-435, 443-452, 463-469, 476-484, 486-494, 503-509, 529-553, 560-565, 570-590, 608-614, 619-627, 654-661, 744-750, 772-780, 784-790, 806-816, 836-853, 876-885, 912-918, 926-933, 961-975, 980-987, 996-1006, 1016-1028, 1043-1053, 1057-1062, 994-1003 and 1033-1056 of Seq ID No 292; 17-45, 64-71, 73-81, 99-109, 186-192, 223-238, 262-275, 283-295, 336-346, 350-363, 375-385, 410-421, 425-431, 441-448, 454-463, 468-474, 476-512, 523-537, 539-552, 568-583, 599-608, 612-620, 628-641, 644-654, 656-662, 670-681, 685-695, 702-708, 716-723, 725-735, 757-764, 769-798, 800-806, 808-816, 826-840, 846-854, 856-862, 874-881, 885-902, 907-928, 274-350 and 443-513 of Seq ID No 293; 4-22, 29-41, 45-51, 53-61, 70-76, 85-92, 99-104, 111-122, 134-140, 142-154, 163-174, 224-232, 255-265, 273-279, 283-297, 330-335, 337-348, 356-367, 373-385, 391-396, 421-431, 442-455, 475-485, 493-505, 526-538, 544-561, 587-599, 605-620, 622-651, 662-670, 675-681, 687-692, 697-712, 714-735 and 252-262 of Seq ID No 294; 4-12, 15-35, 40-46, 50-59, 67-94, 110-128, 143-169, 182-188, 207-215, 218-228, 238-250 and 74-90 of Seq ID No 295; 9-18, 42-58, 78-85, 88-95, 97-106, 115-122, 128-134, 140-145, 154-181, 186-202, 204-223, 261-267, 269-278, 284-293, 300-336, 358-368 and 12-29 of Seq ID No 296; 7-34, 46-53, 62-72, 82-88, 100-105, 111-117, 132-137, 144-160, 166-180, 183-189, 209-221, 231-236, 246-253, 268-282, 286-293, 323-336, 364-372, 378-392, 422-433 and 388-405 of Seq ID No 297; 21-27, 34-50, 72-77, 80-95, 164-177, 192-198, 202-220, 226-236, 239-247, 270-279, 285-292, 315-320, 327-334, 348-355, 364-371, 388-397, 453-476, 488-497, 534-545, 556-576, 582-588, 601-607, 609-616, 642-662, 674-681, 687-697, 709-715, 721-727, 741-755 and 621-739 of Seq ID No 298; 4-14, 16-77, 79-109 and 25-99 of Seq ID No 299; 4-9, 17-23, 30-37, 44-55, 65-72, 77-93, 102-121, 123-132, 146-153 and 17-29 of Seq ID No 300; 4-18, 25-41, 52-60, 83-92, 104-112, 117-123, 149-155, 159-167, 170-192, 201-210, 220-227, 245-250 and 124-137 of Seq ID No 301; 8-25, 50-55, 89-95, 138-143, 148-153, 159-169, 173-179, 223-238, 262-268, 288-295, 297-308, 325-335, 403-409, 411-417, 432-446, 463-475, 492-501, 524-530, 542-548, 561-574, 576-593, 604-609, 612-622, 637-654, 665-672, 678-685, 720-725, 731-739, 762-767, 777-783, 820-838, 851-865, 901-908, 913-920, 958-970, 1000-1006, 1009-1015, 1020-1026, 1043-1052, 1055-1061, 1-128, 252-341, 771-793 and 1043-1058 of Seq ID No 302; 16-26, 33-46 and 64-76 of Seq ID No 303; 4-27, 69-77, 79-101, 117-123, 126-142, 155-161, 171-186, 200-206, 213-231, 233-244, 267-273, 313-329, 335-344, 347-370, 374-379, 399-408, 422-443, 445-453, 461-468, 476-482, 518-534, 544-553, 556-567, 578-595, 601-620, 626-636, 646-658, 666-681, 715-721, 762-768, 778-785, 789-803, 809-819, 22-108, 153-318, 391-527 and 638-757 of Seq ID No 304; 6-21, 32-43, 62-92, 104-123, 135-141, 145-152, 199-216, 218-226, 237-247, 260-269, 274-283, 297-303, 1-72 and 127-211 of Seq ID No 305; 6-26, 50-56, 83-89, 108-114, 123-131, 172-181, 194-200, 221-238, 241-247, 251-259, 263-271, 284-292, 304-319, 321-335, 353-358, 384-391, 408-417, 424-430, 442-448, 459-466, 487-500, 514-528, 541-556, 572-578, 595-601, 605-613, 620-631, 635-648, 660-670, 673-679, 686-693, 702-708, 716-725, 730-735, 749-755, 770-777, 805-811, 831-837, 843-851, 854-860, 863-869, 895-901, 904-914, 922-929, 933-938, 947-952, 956-963, 1000-1005, 1008-1014, 1021-1030, 1097-1103, 1120-1130, 1132-1140, 1-213, 269-592 and 992-1120 of Seq ID No 306; 9-16, 33-39, 47-59, 65-79, 81-95, 103-108, 115-123, 138-148, 163-171, 176-185, 191-196, 205-211, 213-221, 224-256, 261-276, 294-302, 357-363, 384-390, 95-111 and 161-189 of Seq ID No 307; 21-27, 35-45, 70-76, 92-105, 129-143, 145-155, 161-166, 170-191, 204-211, 214-231, 234-246, 249-255, 259-275 and 1-18 of Seq ID No 308; 21-35, 45-53, 56-64, 69-97 and 1-16 of Seq ID No 309; 25-33, 41-47, 61-68, 86-101, 106-114, 116-129, 134-142, 144-156, 163-176, 181-190, 228-251, 255-261, 276-292, 295-305, 334-357, 368-380, 395-410, 424-429, 454-460, 469-482, 510-516, 518-527, 531-546, 558-570, 579-606, 628-636, 638-645, 651-656, 668-674, 691-698, 717-734, 742-754, 765-770, 792-797, 827-835, 847-859, 874-881, 903-909, 926-933, 942-961, 964-977, 989-1004, 1010-1028, 1031-1047, 1057-1075, 1081-1095, 1108-1117, 1138-1144, 1182-1189, 1193-1206, 1220-1229, 1239-1246, 1257-1267, 1271-1279, 1284-1301, 1312-1320, 1329-1335, 1341-1347, 1358-1371, 1399-1404, 1417-1426, 1458-1463, 1468-1476, 1478-1485, 1493-1506, 1535-1541, 1559-1574, 1583-1590, 1595-1601, 1603-1611, 1622-1628, 1634-1644, 1671-1685, 1689-1696, 1715-1720, 1734-1746, 1766-1775, 1801-1806, 1838-1844, 1858-1871, 1910-1917, 1948-1955, 1960-1974, 2000-2015, 2019-2036, 2041-2063, 748-847 and 1381-1391 of Seq ID No 310; 5-12, 18-24, 27-53, 56-63, 96-113, 119-124, 131-136, 157-163, 203-209, 215-223, 233-246, 264-273, 311-316, 380-389, 393-399, 425-433, 445-450, 457-462, 464-470, 475-482, 507-513, 527-535, 542-548, 550-565, 591-602, 607-613, 627-642, 644-664, 673-712, 714-732, 739-764, 769-782, 812-818, 826-838, 848-854, 860-871, 892-906, 930-938, 940-954, 957-973, 990-998, 1002-1021, 1024-1033, 1037-1042, 1050-1060, 1077-1083, 1085-1092, 1100-1129, 1144-1161, 1169-1175, 1178-1189, 1192-1198, 1201-1207, 1211-1221, 1229-1239, 1250-1270, 1278-1292, 1294-1300, 1314-1335, 1344-1352, 1360-1374, 1394-1405, 1407-1414, 1416-1424, 1432-1452, 1456-1462, 1474-1497, 1500-1510, 1516-1522, 1534-1542, 1550-1559, 1584-1603, 1608-1627, 187-273 and 306-441 of Seq ID No 311; 70-80, 90-97, 118-125, 128-140, 142-148, 154-162, 189-202, 214-222, 224-232, 254-260, 275-313, 317-332, 355-360, 392-398, 425-432, 448-456, 464-470, 476-482, 491-505, 521-528, 533-546, 560-567, 592-597, 605-614, 618-626, 637-644, 646-653, 660-666, 677-691 and 207-227 of Seq ID No 312; 5-19, 26-34, 37-55, 57-66, 69-83, 86-102, 115-134, 138-143, 154-172, 178-195, 209-246, 251-257, 290-302, 306-311 and 256-266 of Seq ID No 313; 10-20, 22-28, 35-57, 72-79, 87-103, 108-128, 130-144, 158-171, 190-198, 225-242, 274-291, 301-315, 317-324, 374-385 and 353-365 of Seq ID No 314; 4-9, 17-30, 34-54, 59-66, 73-94, 118-130, 135-150, 158-171, 189-198, 219-239, 269-275, 283-301, 89-106 and 176-193 of Seq ID No 315; 14-20, 22-74, 77-86, 89-99, 104-109, 126-135, 154-165, 181-195, 197-212, 216-224, 264-275 and 107-118 of Seq ID No 316; 4-18, 21-38, 63-72, 101-109, 156-162, 165-179, 183-192, 195-210, 212-218, 230-239, 241-256, 278-290, 299-311, 313-322, 332-341, 348-366, 386-401, 420-426, 435-450, 455-460, 468-479, 491-498, 510-518, 532-538, 545-552, 557-563, 567-573, 586-595, 599-609, 620-626, 628-636, 652-657, 665-681 and 1-198 of Seq ID No 317; 4-10, 16-38, 51-68, 73-79, 94-115, 120-125, 132-178, 201-208, 216-223, 238-266, 269-295, 297-304, 337-342, 347-356, 374-401, 403-422, 440-447, 478-504, 510-516, 519-530, 537-544 and 191-206 of Seq ID No 318; 12-40, 42-48, 66-71, 77-86, 95-102, 113-120, 129-137, 141-148, 155-174, 208-214, 218-225, 234-240, 256-267, 275-283, 300-306, 313-321, 343-350, 359-367, 370-383, 398-405, 432-439, 443-461, 492-508, 516-526, 528-535 and 370-478 of Seq ID No 319; 6-14, 20-37, 56-62, 90-95, 97-113, 118-125, 140-145, 161-170, 183-202, 237-244, 275-284, 286-305, 309-316, 333-359, 373-401, 405-412 and 176-187 of Seq ID No 320; 33-44, 50-55, 59-80, 86-101, 129-139, 147-153, 157-163, 171-176, 189-201, 203-224, 239-245, 257-262, 281-287, 290-297, 304-320, 322-331, 334-350, 372-390, 396-401, 71-88 and 353-372 of Seq ID No 321; 5-11, 15-24, 26-33, 40-47, 75-88, 95-103, 105-112 and 17-30 of Seq ID No 322; 5-11, 16-39, 46-54, 62-82, 100-107, 111-124, 126-150, 154-165, 167-183, 204-238, 245-295, 301-313, 316-335 and 8-16 of Seq ID No 323; 4-19, 34-48, 69-74, 79-107, 115-127, 129-135, 143-153, 160-169, 171-182 and 142-153 of Seq ID No 324; 4-30, 65-74, 82-106, 110-120, 124-132, 135-140, 146-175, 179-184, 190-196, 217-223, 228-233, 250-267, 275-292, 303-315, 322-332 and 174-186 of Seq ID No 325; 9-16, 29-41, 47-57, 68-84, 87-109, 113-119, 162-180, 186-193, 195-201, 203-208, 218-230, 234-243, 265-271, 281-292, 305-312, 323-332, 341-347, 349-363, 368-374, 383-390, 396-410, 434-440, 446-452, 455-464, 466-473, 515-522, 529-542, 565-570, 589-600, 602-613, 618-623, 637-644, 1019-1027, 1238-1244, 1258-1264, 1268-1276, 1281-1292, 1296-1302 and 883-936 of Seq ID No 326; 10-17, 23-32, 39-44, 54-72, 75-81, 88-111, 138-154, 160-167, 178-185, 201-210, 236-252, 327-334, 336-342, 366-376, 388-400, 410-430, 472-482, 493-526, 552-558, 586-592, 598-603, 612-621, 630-635, 641-660 and 384-393 of Seq ID No 327; 4-22, 24-39, 50-59, 73-84, 100-105, 111-117, 130-138, 155-161, 173-178, 182-189, 205-215, 266-284, 308-313, 321-328, 330-337, 346-363, 368-374, 388-395, 397-405, 426-434, 453-459, 482-492, 501-507, 509-515, 518-523, 527-544, 559-590, 598-612, 614-629, 646-659, 663-684, 686-694, 698-721 and 445-461 of Seq ID No 328; 14-22, 27-33 and 3-17 of Seq ID No 329; 29-41, 66-73, 81-87, 90-108, 140-146, 150-159, 165-184, 186-196, 216-226, 230-238, 247-253, 261-269 and 126-140 of Seq ID No 330; 5-12, 16-25, 27-33, 36-45, 60-68, 83-88, 103-126 and 86-101 of Seq ID No 331; 14-23, 36-47, 56-66, 84-89, 94-105, 111-127, 140-153, 160-174, 176-183, 189-203, 219-225, 231-237, 250-257 and 194-227 of Seq ID No 332; 4-25, 54-60, 64-71, 73-82, 89-106, 117-124, 157-169, 183-188, 199-210, 221-232, 236-244, 255-264 and 58-98 of Seq ID No 333; 13-19, 26-36, 41-53, 55-71, 77-84, 86-108, 114-135, 157-172, 177-183, 187-194, 208-213, 218-226, 110-125 and 156-170 of Seq ID No 334; 5-24, 63-69, 77-85, 94-112, 120-137, 140-146, 152-159, 166-172, 179-187, 193-199, 206-212, 222-228, 234-240, 244-252, 257-264, 270-289, 298-309, 316-328, 337-348, 363-375, 1-56 and 340-352 of Seq ID No 335; 18-39, 42-71, 78-120, 124-144, 152-173, 179-189, 199-209, 213-222, 228-258, 269-304, 329-361, 364-372, 374-389, 396-441 and 313-327 of Seq ID No 336; 19-25, 91-98, 108-120, 156-162, 168-174, 191-204, 211-216, 232-266, 272-278, 286-308, 316-321, 327-333, 344-355, 358-364, 384-391, 395-428, 464-476, 487-495, 497-511, 544-561, 563-573, 575-582, 588-594, 10-25 and 322-338 of Seq ID No 337; 14-26, 32-49, 51-57, 59-72, 80-91, 102-112, 119-125, 147-161, 164-173, 175-183, 188-213, 217-222, 246-254, 260-276, 282-303, 308-318, 321-328, 333-350, 352-359, 371-378, 392-401, 407-414, 416-443, 448-463, 471-484, 490-497, 501-514, 519-527, 539-551, 557-570, 578-590, 592-598, 600-610, 618-629, 633-647, 654-667, 676-689, 702-709, 718-726, 728-737, 741-760, 764-780, 786-795, 808-826, 836-842, 845-852, 865-874, 881-887, 931-945, 949-957, 968-974, 979-986, 1003-1009, 1023-1029 and 90-103 of Seq ID No 338; 11-16, 37-56, 60-66, 69-77, 80-88, 93-106, 117-139, 166-171 and 72-90 of Seq ID No 339; 59-84, 123-133, 145-150, 161-167, 178-189 and 115-128 of Seq ID No 340; 15-33, 39-46, 52-64, 74-87, 108-124, 127-144, 150-156, 173-179, 184-194, 201-208, 219-236, 243-269, 272-295, 302-309, 343-349, 356-361, 370-379, 405-411, 414-423, 430-451, 457-464, 466-475, 477-483, 496-502, 507-522, 541-548, 557-563, 571-577, 579-585, 590-605, 626-642, 650-662, 671-691, 704-710, 751-769, 775-781, 786-791, 794-829, 851-858, 868-878, 884-904, 913-919, 931-939 and 132-142 of Seq ID No 341; 33-58, 64-71, 74-80, 83-88, 96-120, 122-139, 146-157, 167-177, 207-213, 220-225, 236-242, 264-279, 300-305, 326-336, 340-347, 350-360, 97-115 and 199-211 of Seq ID No 342; 4-26, 43-57, 70-99, 102-117, 121-133, 142-148, 151-168, 170-183, 192-220, 235-249, 258-279 and 30-41 of Seq ID No 343; 34-42, 48-58, 70-94, 110-130, 154-160, 164-172, 178-183, 195-203, 211-222, 229-250, 256-261, 274-284, 286-292, 312-323 and 222-233 of Seq ID No 344; 4-9, 15-36, 38-45, 49-74, 78-88, 100-112, 136-191, 211-220, 226-233, 239-246, 254-274, 287-307, 316-322, 342-353, 356-366, 373-378, 384-393, 405-431, 449-457, 459-468, 487-511, 515-524, 529-541, 544-552, 562-568, 571-576 and 208-280 of Seq ID No 345; 10-27, 31-37, 39-54, 71-108, 124-143 and 2-107 of Seq ID No 346; 16-27, 38-57, 64-70, 90-102, 104-113, 116-137, 160-166 and 1-80 of Seq ID No 347; 13-21, 31-36, 56-67, 127-136, 153-171, 173-180, 184-200, 214-222, 225-231, 239-263, 267-273 and 135-159 of Seq ID No 348; 12-27, 31-51, 68-74, 77-87, 94-101, 108-114, 117-123, 127-134, 138-168, 173-196, 201-207, 212-217, 227-237, 247-257, 264-280 and 205-223 of Seq ID No 349; 17-22, 25-54, 70-76, 92-100 and 98-110 of Seq ID No 350; 7-29, 40-50, 60-67, 87-96, 105-111, 119-164, 172-199, 206-212, 220-227, 237-259, 272-279, 282-293, 295-309, 313-319, 321-328, 345-363, 376-386 and 159-176 of Seq ID No 351; 4-19, 24-30, 36-43, 50-68, 71-89, 93-106, 141-152, 154-172, 179-197, 199-215, 229-239, 246-252, 255-263, 281-298, 319-325, 329-356, 358-368, 374-390, 397-409, 420-429, 432-444, 450-456, 459-475, 483-494, 496-502, 520-528, 532-556 and 362-377 of Seq ID No 352; 18-25, 40-62, 77-85, 91-97, 105-116, 123-133, 139-184, 189-197 and 122-140 of Seq ID No 353; 4-49, 52-58, 62-70, 79-105, 109-133, 142-150, 163-168, 206-214, 220-228, 233-240, 243-254, 274-281, 303-311, 327-338, 357-373, 378-396, 403-413, 420-436, 441-453, 461-467, 475-481, 484-498, 506-512, 514-521, 523-529, 562-579, 589-595, 598-603, 615-648, 714-722, 728-742, 749-758, 777-792, 795-807 and 643-658 of Seq ID No 354; 8-27, 37-48, 51-56, 72-79, 87-106, 120-138, 140-147, 167-176, 187-197, 205-216, 222-229, 234-239, 243-249, 277-288, 292-315, 334-343, 347-353, 363-391, 398-404, 430-447, 461-467, 478-492, 498-507 and 456-470 of Seq ID No 355; 5-12, 18-24, 59-69, 80-93, 95-109, 119-125, 130-137, 139-147, 158-163, 168-176, 182-202, 206-215, 222-239, 241-249, 267-277, 291-298, 311-318, 321-327, 338-344, 348-355, 373-386, 393-406, 411-417, 434-443, 446-465, 473-484, 514-521, 532-553, 584-594 and 221-237 of Seq ID No 356; 4-14, 27-34, 50-58, 63-72, 79-106, 109-114, 121-142, 146-154, 161-167, 169-175, 178-201, 223-238, 249-254, 259-264, 278-292, 294-312, 319-330 and 167-191 of Seq ID No 357; 7-28, 36-42, 50-61, 63-80, 122-152, 161-174, 176-191 and 140-190 of Seq ID No 358; 20-57, 59-65, 70-78, 86-102, 119-133, 142-161, 163-173, 177-188, 192-202, 204-220, 222-236, 240-253, 279-319, 326-331, 337-383, 390-399, 406-412, 420-427, 431-438 and 381-395 of Seq ID No 359; 13-18, 28-34, 37-43, 50-59, 75-81, 83-97, 105-121, 139-147, 200-206, 209-227, 231-247, 260-271, 318-327, 366-381, 388-394, 399-406 and 182-201 of Seq ID No 360; 6-29, 37-43, 51-56, 70-77, 82-102, 110-119, 127-143, 178-190, 201-209, 216-243, 261-269, 281-292, 305-313, 327-339, 341-354, 356-373, 391-397, 423-429, 438-445, 450-478 and 21-314 of Seq ID No 361; 4-12, 15-21, 32-41, 59-76, 80-89, 96-104 and 90-103 of Seq ID No 362; 9-28, 30-41, 44-54, 69-74, 77-82, 90-97, 104-123, 125-135, 149-155, 164-173, 177-184, 217-226, 230-235, 238-244, 258-272, 282-297, 300-305, 309-315, 317-322, 327-336, 348-362, 368-374, 380-387, 400-411, 414-424, 451-458, 460-466, 483-494, 497-503, 506-511, 521-528, 540-553, 569-587, 598-606, 628-642, 661-681, 688-700, 718-733, 740-749, 752-764, 769-783, 823-834, 848-854, 862-872, 878-884, 886-898, 915-920, 938-951, 954-961, 963-972, 982-989, 996-1003, 1010-1016, 1021-1032, 1038-1044, 1047-1057, 1060-1070, 1079-1088, 1094-1102, 1117-1127, 1129-1135, 1142-1153, 1158-1204, 1212-1229, 1234-1263, 1269-1277, 1308-1313, 1327-1338, 1344-1376, 1400-1415, 1436-1443, 1448-1458, 1497-1504, 1511-1522, 1544-1566, 3-82 and 509-576 of Seq ID No 363; 8-36, 40-64, 71-79, 88-94, 102-109, 118-127, 138-148, 151-159, 163-174, 192-198, 200-206, 220-233, 268-273, 290-301, 304-309, 316-323, 331-349, 378-391, 414-420, 427-437, 455-475, 494-510, 541-547, 549-555, 616-640, 1-60, 55-139, 212-308, 386-458 and 458-624 of Seq ID No 364; 16-31, 35-42, 70-77, 91-101, 120-130, 132-140, 143-153, 185-190, 195-202, 215-222, 228-238, 241-251, 257-264, 268-277, 288-302, 312-324, 326-333, 341-348, 364-382, 415-429, 438-454, 458-466, 491-499, 501-521 and 273-281 of Seq ID No 365; 8-14, 32-57, 74-149, 155-177, 179-212, 221-266, 271-296, 304-324, 329-346, 349-359, 368-401, 413-419, 426-454, 465-478, 493-510 and 466-490 of Seq ID No 366; 22-28, 33-51, 64-89, 96-119, 126-132, 138-146, 152-159, 161-169, 172-179, 193-198, 205-211, 221-231, 235-254, 273-280, 297-303, 312-320, 328-346, 351-373, 378-384, 391-398, 448-454, 460-468, 470-481, 516-558, 574-593, 597-602, 613-623, 626-646, 649-656, 668-673, 675-683, 696-708, 715-722, 724-739, 745-751, 759-777, 780-804, 816-822 and 102-113 of Seq ID No 367; 12-28, 41-91, 98-107, 112-120, 125-131, 151-193, 215-221, 240-250, 263-280 and 128-138 of Seq ID No 368; 16-24, 32-38, 46-62, 68-81, 90-105, 127-133, 144-150, 160-166, 178-184, 186-202, 210-219, 232-240, 252-258, 264-273, 293-324, 337-344, 349-357, 360-369, 385-398, 410-416, 419-427, 441-449, 458-476, 508-515, 523-539, 544-549, 562-569, 571-579, 96-109 and 127-139 of Seq ID No 369; 19-25, 28-34, 56-61, 85-97, 110-116 and 39-53 of Seq ID No 370; 4-37, 41-50, 62-72, 91-97, 99-109, 114-125, 136-141, 149-158, 160-166, 201-215 and 27-225 of Seq ID No 371; 15-31, 44-51, 96-105, 122-130, 149-157, 162-168, 178-183, 185-192, 198-204, 206-213, 221-234, 239-245, 248-255, 257-266, 289-335, 349-357, 415-422, 425-441, 448-454, 462-468 and 463-481 of Seq ID No 372; 5-31, 39-55, 63-72, 76-99, 106-155, 160-177, 179-199, 207-217, 223-240, 245-255, 261-267, 294-316, 321-343, 354-378, 382-452, 477-488, 529-536, 555-569, 584-591, 593-612, 620-627, 632-640, 647-654, 671-680, 698-704, 723-730, 732-750, 769-775, 781-788, 822-852 and 505-525 of Seq ID No 373; 3-18 of Seq ID No 374; 4-14 and 12-24 of Seq ID No 375; 4-11, 22-30 and 12-25 of Seq ID No 376; 5-12 and 4-18 of Seq ID No 377; 4-28 and 7-14 of Seq ID No 378; 6-16 and 8-16 of Seq ID No 379; 4-15, 18-33 and 24-36 of Seq ID No 380; 4-10, 16-21 and 20-31 of Seq ID No 381; 6-19 of Seq ID No 382; 11-18 and 3-10 of Seq ID No 383; 13-24 and 3-15 of Seq ID No 384; 15-27 and 7-16 of Seq ID No 385; 11-16 and 1-15 of Seq ID No 386; 4-16 and 9-21 of Seq ID No 387; 4-24, 40-48, 54-67 and 22-39 of Seq ID No 388; 6-30, 34-55, 62-68, 78-106 and 68-74 of Seq ID No 389; 3-14 of Seq ID No 390; 9-19 and 6-21 of Seq ID No 391; 4-17 and 1-9 of Seq ID No 392; 5-30 and 1-8 of Seq ID No 393; 4-16, 23-46, 51-56 and 45-55 of Seq ID No 394; 7-16 of Seq ID No 395; 2-14 of Seq ID No 396; 4-36, 43-65 and 50-62 of Seq ID No 397; 10-30 and 14-21 of Seq ID No 398; 9-17 and 1-10 of Seq ID No 399; 4-12 and 3-16 of Seq ID No 400; 4-15 and 5-23 of Seq ID No 401; 10-21 of Seq ID No 402; 6-16 of Seq ID No 403; 4-29, 31-38 and 2-14 of Seq ID No 404; 4-35 and 33-42 of Seq ID No 405; 2-17 of Seq ID No 406; 9-18, 30-35 and 15-33 of Seq ID No 407; 4-9 and 6-12 of Seq ID No 408; 3-17 of Seq ID No 409; 12-21, 37-44, 52-61, 72-80 and 38-48 of Seq ID No 410; 4-10, 29-44, 54-61, 69-78 and 13-27 of Seq ID No 411; 13-23, 36-53 and 2-15 of Seq ID No 412; 4-25, 28-46, 56-72, 81-99, 120-132, 134-142, 154-160 and 129-141 of Seq ID No 413; 4-15, 24-33, 35-41, 64-86 and 21-33 of Seq ID No 414; 9-15 and 4-13 of Seq ID No 415; 4-11, 13-19, 34-48 and 15-32 of Seq ID No 416; 4-21 and 11-31 of Seq ID No 417; 23-57 and 38-50 of Seq ID No 418; 4-32 and 3-13 of Seq ID No 419; 4-10, 13-25, 32-42, 56-68, 72-84 and 26-38 of Seq ID No 420; 4-20, 31-48, 52-58, 65-71, 80-93, 99-108, 114-123 and 37-49 of Seq ID No 421; 6-12, 14-20 and 3-25 of Seq ID No 422; 14-25, 27-38 and 5-14 of Seq ID No 423; 4-41, 57-105, 109-118, 123-136, 144-152 and 86-99 of Seq ID No 424; 6-19 of Seq ID No 425; 2-19 of Seq ID No 426; 14-47 and 1-14 of Seq ID No 427; 4-21, 29-44 and 2-18 of Seq ID No 428; 23-29 and 10-28 of Seq ID No 429; 6-16, 22-36 and 11-22 of Seq ID No 430; 4-19, 30-44 and 18-27 of Seq ID No 431; 5-15, 37-45, 58-65 and 38-47 of Seq ID No 432; 4-15, 23-34 and 4-15 of Seq ID No 433; 30-36, 44-54, 79-85, 101-114, 138-152, 154-164, 170-175, 179-200, 213-220, 223-240, 243-255, 258-264, 268-284 and 10-28 of Seq ID No 434; the peptides comprising amino acid sequences of column "Identical region" of the Table 1B, especially peptides comprising amino acid 210-226 and 738-753 of Seq ID No 449; 326-344, 326-348, 338-354, 371-392, 801-809 and 877-901 of Seq ID No 450; 893-906 of Seq ID No 451; 51-69 of Seq ID No 452; 110-125 of Seq ID No 453; 291-305 of Seq ID No 454; 210-226 and 738-753 of Seq ID No 455; 326-344, 326-348, 338-354, 371-392, 801-809 and 877-901 of Seq ID No 456; 893-906 of Seq ID No 457; 51-69 of Seq ID No 458; 110-125 of Seq ID No 459; 291-305 of Seq ID No 460; 32-44 of Seq ID No 461; 399-410 of Seq ID No 462; the serum reactive epitopes as specified in the column of "aa from" to "aa to" of Table 2, especially peptides comprising amino acid 120-143, 138-161 and 156-179 of Seq ID No 218; 110-129 and 168-184 of Seq ID No 219; 74-90 of Seq ID No 222; 759-773 of Seq ID No 223; 237-260 of Seq ID No 224; 265-284 of Seq ID No 225; 65-74 of Seq ID No 226; 41-50 of Seq ID No 227; 163-174 of Seq ID No 229; 26-37 of Seq ID No 230; 174-189 of Seq ID No 232; 240-256 of Seq ID No 234; 285-297 of Seq ID No 236; 238-247 of Seq ID No 238; 491-519 of Seq ID No 239; 114-140 of Seq ID No 243; 267-284 of Seq ID No 250; 439-453 of Seq ID No 252; 162-178 of Seq ID No 253; 347-364 of Seq ID No 254; 699-715 of Seq ID No 255; 60-71 of Seq ID No 256; 244-257 of Seq ID No 257; 44-63 and 57-76 of Seq ID No 258; 185-196 of Seq ID No 260; 119-129 of Seq ID No 263; 182-195 of Seq ID No 266; 32-44 and 424-442 of Seq ID No 267; 247-256 of Seq ID No 268; 678-694, 785-805, 55-77 and 72-94 of Seq ID No 269; 210-226 of Seq ID No 281; 37-59 of Seq ID No 289; 13-29 of Seq ID No 296; 136-159 of Seq ID No 348; 205-222 of Seq ID No 349; 99-110 of Seq ID No 350; 160-176 of Seq ID No 351; 457-470 of Seq ID No 355; 221-237 of Seq ID No 356; 167-190 of Seq ID No 357; 96-120 of Seq ID No 361; 399-417, 503-519 and 544-563 of Seq ID No 364; 46-68, 159-183 and 184-198 of Seq ID No 371; 463-481 of Seq ID No 372; the immunogenic epitopes as specified in the column of "aa from" to "aa to" of Table 4; especially peptides comprising amino acid 110-129 and 168-184 of Seq ID No 219; 877-901, 333-354, 326-344 and 801-809 of Seq ID No 277; 1-54 of Seq ID No 347; 544-563, 31-51, 107-119, 399-417 and 503-519 of Seq ID No 364; 120-198 of Seq ID No 218; 20-35 of Seq ID No 219; 118-201 of Seq ID No 221; 48-132 of Seq ID No 242; 118-136 of Seq ID No 249; 162-178 of Seq ID No 253; 347-364 of Seq ID No 254; 699-715 of Seq ID No 255; 50-76 of Seq ID No 258; 785-819 and 44-128 of Seq ID No 269; 90-128 of Seq ID No 274; 314-384 of Seq ID No 289; 327-349 of Seq ID No 293; 242-314, 405-478 and 23-100 of Seq ID No 304; 129-210 of Seq ID No 305; 162-188 of Seq ID No 307; 750-772 of Seq ID No 310; 1-56 of Seq ID No 335; 322-337 of Seq ID No 337; 72-90 of Seq ID No 339; 374-395 of Seq ID No 345; 136-159 of Seq ID No 348; 141-164 of Seq ID No 358; 96-157 of Seq ID No 361; 1-82 of Seq ID No 363; 489-556 of Seq ID No 364; 159-183 and 49-133 of Seq ID No 371; The peptides comprising amino acid sequences of column "predicted immunogenic aa" and "location of identified immunogenic region (aa)" of Table 5, especially peptides comprising amino acid 4-26, 35-41, 53-61, 73-84, 103-108, 114-120, 140-146, 156-162, 192-208, 214-219, 227-233, 239-252, 260-268, 284-297, 1-48 and 113-133 of Seq ID No 475; 4-27, 38-44, 50-56, 59-64, 72-79, 83-89, 92-97, 108-116, 123-148, 152-167, 183-196, 200-220, 232-244, 255-261, 265-274, 282-302, 309-317, 1-79 and 231-302 of Seq ID No 476; 6-28, 66-72, 85-105, 115-121, 144-151, 160-170, 176-185, 223-230, 252-288, 296-310, 319-333, 367-374, 458-464, 471-480, 483-488, 520-528, 530-549, 559-564, 593-601, 606-616, 636-643, 655-662, 676-682, 684-699, 719-726, 735-750, 757-764, 777-785, 799-810, 812-843, 846-853, 868-873, 880-889, 891-899, 909-929, 934-940, 963-969, 998-1004, 1007-1014, 1016-1022, 1030-1046, 1-80 and 808-821 of Seq ID No 477; 7-24, 35-41, 75-81, 91-114, 122-132, 137-144, 148-156, 183-192, 194-200, 212-228, 233-238, 251-258, 275-295, 326-332, 337-346, 1-79 and 305-321 of Seq ID No 478; 31-38, 42-52, 66-72, 86-92, 98-104, 115-122, 127-146, 154-164, 169-187, 198-212, 225-237, 255-269, 13-92 and 135-142 of Seq ID No 479; 4-36, 39-49, 63-69, 71-77, 81-88, 123-131, 133-139, 160-169, 174-180, 188-194, 210-217, 273-278, 289-300, 317-334, 336-341, 383-401, 425-438, 1-68, 212-270 and 402-446 of Seq ID No 480; 21-29, 31-42, 49-63, 72-79, 81-93, 112-132, 159-165, 188-195, 197-232, 262-267, 279-286, 294-301, 318-326, 348-366, 381-405, 409-426, 436-465, 471-480, 484-492, 497-505, 521-544, 554-561, 567-577, 581-589, 601-609, 611-622, 636-651, 653-667, 669-685, 700-708, 716-722, 729-744, 749-766, 780-786, 789-811, 814-864, 1-57 and 84-106 of Seq ID No 481; 6-24, 35-48, 57-63, 72-78, 87-92, 113-119, 123-137, 147-153, 173-181, 212-233 and 1-124 of Seq ID No 482; 13-34, 62-69, 78-83, 86-91, 98-104, 107-115, 146-159, 179-188, 195-205, 209-221, 226-233, 239-253, 276-282, 284-294, 297-308, 331-354, 375-382, 388-399, 421-433, 449-458, 464-469, 472-491, 508-513, 525-531, 534-550, 575-593, 601-618, 629-635, 654-661, 666-680, 706-721, 723-740, 771-805, 810-830, 845-851 and 1-84 of Seq ID No 483; 4-32, 45-64, 73-83, 86-92, 100-111, 125-147, 157-163, 170-175, 177-188, 226-232, 245-252, 258-274, 320-335, 348-359 and 1-71 of Seq ID No 484; 13-40, 43-71, 76-83, 87-101, 109-119, 125-156, 162-175, 182-219, 226-232, 240-262, 270-287, 306-318, 326-342, 344-408, 414-444, 449-456 and 1-51 of Seq ID No 485; 4-16, 18-34, 45-54, 99-108, 134-140, 203-212, 241-257, 266-274, 279-291, 308-315, 330-336, 355-370, 374-382, 402-410, 428-455, 466-472, 474-480, 531-554, 560-566, 572-580, 597-618, 632-660, 664-674, 676-685, 691-705, 708-735, 750-768, 1-87 and 342-480 of Seq ID No 486; The serum reactive epitopes as specified in the column of "aa from" to "aa to" of Table 6, especially peptides comprising amino acid 115-132 and 1-26 of Seq ID No 475; 33-55 of Seq ID No 476; 1-25 of Seq ID No 478; 37-61 of Seq ID No 479; 1-24 of Seq ID No 480; 1-23 of Seq ID No 481; 46-60 of Seq ID No 482; 1-28, 23-50 and 45-71 of Seq ID No 483; 1-22 and 17-38 of Seq ID No 484;

1-22 and 17-38 of Seq ID No 485; 1-27, 22-47 and 422-447 of Seq ID No 486; The immunogenic epitopes as specified in the column of "aa from" to "aa to" of Table 7, especially peptides comprising amino acid 115-132 and 1-47 of Seq ID No 475; 1-55 of Seq ID No 476; 22-85 of Seq ID No 477; 307-320 and 1-44 of Seq ID No 478; 15-76 and 40-92 of Seq ID No 479; 1-59, 213-269 and 403-445 of Seq ID No 480; 1-56 and 85-105 of Seq ID No 481; 37-121 of Seq ID No 482; 1-71 of Seq ID No 483; 1-38 of Seq ID No 484; 1-38 of Seq ID No 485; 1-47 of Seq ID No 486.

The present invention also provides a process for producing a *S. agalactiae* hyperimmune serum reactive antigen or a fragment thereof according to the present invention comprising expressing one or more of the nucleic acid molecules according to the present invention in a suitable expression system.

Moreover, the present invention provides a process for producing a cell, which expresses a *S agalactiae* hyperimmune serum reactive antigen or a fragment thereof according to the present invention comprising transforming or transfecting a suitable host cell with the vector according to the present invention.

According to the present invention a pharmaceutical composition, especially a vaccine, comprising a hyperimmune serum-reactive antigen or a fragment thereof as defined in the present invention or a nucleic acid molecule as defined in the present invention is provided.

In a preferred embodiment the pharmaceutical composition further comprises an immunostimulatory substance, preferably selected from the group comprising polycationic polymers, especially polycationic peptides, immunostimulatory deoxynucleotides (ODNs), peptides containing at least two LysLeuLys motifs, especially KLKL5KLK (SEQ ID NO:487), neuroactive compounds, especially human growth hormone, alumn, Freund's complete or incomplete adjuvants or combinations thereof.

In a more preferred embodiment the immunostimulatory substance is a combination of either a polycationic polymer and immunostimulatory deoxynucleotides or of a peptide containing at least two LysLeuLys motifs and immunostimulatory deoxynucleotides.

In a still more preferred embodiment the polycationic polymer is a polycationic peptide, especially polyarginine.

According to the present invention the use of a nucleic acid molecule according to the present invention or a hyperimmune serum-reactive antigen or fragment thereof according to the present invention for the manufacture of a pharmaceutical preparation, especially for the manufacture of a vaccine against *S. agalactiae* infection, is provided.

Also an antibody, or at least an effective part thereof, which binds at least to a selective part of the hyperimmune serum-reactive antigen or a fragment thereof according to the present invention, is provided herewith.

In a preferred embodiment the antibody is a monoclonal antibody.

In another preferred embodiment the effective part of the antibody comprises Fab fragments.

In a further preferred embodiment the antibody is a chimeric antibody.

In a still preferred embodiment the antibody is a humanized antibody.

The present invention also provides a hybridoma cell line, which produces an antibody according to the present invention.

Moreover, the present invention provides a method for producing an antibody according to the present invention, characterized by the following steps:

initiating an immune response in a non-human animal by administrating an hyperimmune serum-reactive antigen or a fragment thereof, as defined in the invention, to said animal, removing an antibody containing body fluid from said animal, and producing the antibody by subjecting said antibody containing body fluid to further purification steps.

Accordingly, the present invention also provides a method for producing an antibody according to the present invention, characterized by the following steps:

initiating an immune response in a non-human animal by administrating an hyperimmune serum-reactive antigen or a fragment thereof, as defined in the present invention, to said animal, removing the spleen or spleen cells from said animal, producing hybridoma cells of said spleen or spleen cells, selecting and cloning hybridoma cells specific for said hyperimmune serum-reactive antigens or a fragment thereof, producing the antibody by cultivation of said cloned hybridoma cells and optionally further purification steps.

The antibodies provided or produced according to the above methods may be used for the preparation of a medicament for treating or preventing *S. agalactiae* infections.

According to another aspect the present invention provides an antagonist, which binds to a hyperimmune serum-reactive antigen or a fragment thereof according to the present invention.

Such an antagonist capable of binding to a hyperimmune serum-reactive antigen or fragment thereof according to the present invention may be identified by a method comprising the following steps:

a) contacting an isolated or immobilized hyperimmune serum-reactive antigen or a fragment thereof according to the present invention with a candidate antagonist under conditions to permit binding of said candidate antagonist to said hyperimmune serum-reactive antigen or fragment, in the presence of a component capable of providing a detectable signal in response to the binding of the candidate antagonist to said hyperimmune serum reactive antigen or fragment thereof; and
b) detecting the presence or absence of a signal generated in response to the binding of the antagonist to the hyperimmune serum reactive antigen or the fragment thereof.

An antagonist capable of reducing or inhibiting the interaction activity of a hyperimmune serum-reactive antigen or a fragment thereof according to the present invention to its interaction partner may be identified by a method comprising the following steps:

a) providing a hyperimmune serum reactive antigen or a hyperimmune fragment thereof according to the present invention,
b) providing an interaction partner to said hyperimmune serum reactive antigen or a fragment thereof, especially an antibody according to the present invention,
c) allowing interaction of said hyperimmune serum reactive antigen or fragment thereof to said interaction partner to form an interaction complex,
d) providing a candidate antagonist,
e) allowing a competition reaction to occur between the candidate antagonist and the interaction complex,
f) determining whether the candidate antagonist inhibits or reduces the interaction activities of the hyperimmune serum reactive antigen or the fragment thereof with the interaction partner.

The hyperimmune serum reactive antigens or fragments thereof according to the present invention may be used for the isolation and/or purification and/or identification of an interaction partner of said hyperimmune serum reactive antigen or fragment thereof.

The present invention also provides a process for in vitro diagnosing a disease related to expression of a hyperimmune serum-reactive antigen or a fragment thereof according to the present invention comprising determining the presence of a nucleic acid sequence encoding said hyperimmune serum reactive antigen or fragment thereof according to the present invention or the presence of the hyperimmune serum reactive antigen or fragment thereof according to the present invention.

The present invention also provides a process for in vitro diagnosis of a bacterial infection, especially a S. agalactiae infection, comprising analyzing for the presence of a nucleic acid sequence encoding said hyperimmune serum reactive antigen or fragment thereof according to the present invention or the presence of the hyperimmune serum reactive antigen or fragment thereof according to the present invention.

Moreover, the present invention provides the use of a hyperimmune serum reactive antigen or fragment thereof according to the present invention for the generation of a peptide binding to said hyperimmune serum reactive antigen or fragment thereof, wherein the peptide is an anticaline.

The present invention also provides the use of a hyperimmune serum-reactive antigen or fragment thereof according to the present invention for the manufacture of a functional nucleic acid, wherein the functional nucleic acid is selected from the group comprising aptamers and spiegelmers.

The nucleic acid molecule according to the present invention may also be used for the manufacture of a functional ribonucleic acid, wherein the functional ribonucleic acid is selected from the group comprising ribozymes, antisense nucleic acids and siRNA.

The present invention advantageously provides an efficient, relevant and comprehensive set of isolated nucleic acid molecules and their encoded hyperimmune serum reactive antigens or fragments thereof identified from S. agalactiae using an antibody preparation from multiple human plasma pools and surface expression libraries derived from the genome of S. agalactiae. Thus, the present invention fulfils a widely felt demand for S. agalactiae antigens, vaccines, diagnostics and products useful in procedures for preparing antibodies and for identifying compounds effective against S. agalactiae infection.

An effective vaccine should be composed of proteins or polypeptides, which are expressed by all strains and are able to induce high affinity, abundant antibodies against cell surface components of S. agalactiae. The antibodies should be IgG1 and/or IgG3 for opsonization, and any IgG subtype and IgA for neutralisation of adherence and toxin action. A chemically defined vaccine must be definitely superior compared to a whole cell vaccine (attenuated or killed), since components of S. agalactiae, which cross-react with human tissues or inhibit opsonization can be eliminated, and the individual proteins inducing protective antibodies and/or a protective immune response can be selected.

The approach, which has been employed for the present invention, is based on the interaction of GBS proteins or peptides with the antibodies present in human sera. The antibodies produced against S. agalactiae by the human immune system and present in human sera are indicative of the in vivo expression of the antigenic proteins and their immunogenicity. In addition, the antigenic proteins as identified by the bacterial surface display expression libraries using pools of pre-selected sera, are processed in a second and third round of screening by individual selected or generated sera. Thus the present invention supplies an efficient, relevant, comprehensive set of GBS antigens as a pharmaceutical composition, especially a vaccine preventing infection by S. agalactiae.

In the antigen identification program for identifying a comprehensive set of antigens according to the present invention, at least two different bacterial surface expression libraries are screened with several serum pools or plasma fractions or other pooled antibody containing body fluids (antibody pools). The antibody pools are derived from a serum collection, which has been tested against antigenic compounds of S. agalactiae, such as whole cell extracts and culture supernatant proteins. Preferably, three distinct serum collections are used, obtained ad 1. from healthy pregnant women tested negative for cervical and anorectal carriage of GBS, ad 2. healthy pregnant women tested positive for cervical and/or anorectal carriage of GBS who's newborn remained GBS-free (although with antibiotic prevention), ad 3. from adults below <45 years of age without clinical disease. Sera have to react with multiple GBS-specific antigens in order to be considered hyperimmune and therefore relevant in the screening method applied for the present invention.

The expression libraries as used in the present invention should allow expression of all potential antigens, e.g. derived from all secreted and surface proteins of S. agalactiae. Bacterial surface display libraries will be represented by a recombinant library of a bacterial host displaying a (total) set of expressed peptide sequences of S. agalactiae on two selected outer membrane proteins (LamB and FhuA) at the bacterial host membrane {Georgiou, G., 1997}; {Etz, H. et al., 2001}. One of the advantages of using recombinant expression libraries is that the identified hyperimmune serum-reactive antigens may be instantly produced by expression of the coding sequences of the screened and selected clones expressing the hyperimmune serum-reactive antigens without further recombinant DNA technology or cloning steps necessary.

The comprehensive set of antigens identified by the described program according to the present invention is analyzed further by one or more additional rounds of screening. Therefore individual antibody preparations or antibodies generated against selected peptides, which were identified as immunogenic are used. According to a preferred embodiment the individual antibody preparations for the second round of screening are derived from pregnant women and non-pregnant adults who show an antibody titer above a certain minimum level, for example an antibody titer being higher than 80 percentile, preferably higher than 90 percentile, especially higher than 95 percentile of the human (patient or healthy individual) sera tested. Using such high titer individual antibody preparations in the second screening round allows a very selective identification of the hyperimmune serum-reactive antigens and fragments thereof from S. agalactiae.

Following the comprehensive screening procedure, the selected antigenic proteins, expressed as recombinant proteins or in vitro translated products, in case it can not be expressed in prokaryotic expression systems, or the identified antigenic peptides (produced synthetically) are tested in a second screening by a series of ELISA and Western blotting assays for the assessment of their immunogenicity with a large human serum collection (minimum ~150 healthy and patients sera).

It is important that the individual antibody preparations (which may also be the selected serum) allow a selective identification of the most promising candidates of all the hyperimmune serum-reactive antigens from all the promising candidates from the first round. Therefore, preferably at least 10 individual antibody preparations (i.e. antibody preparations (e.g. sera) from at least 10 different individuals having suffered from an infection to the chosen pathogen) should be used in identifying these antigens in the second screening round. Of course, it is possible to use also less than 10 individual preparations, however, selectivity of the step may not be optimal with a low number of individual antibody preparations. On the other hand, if a given hyperimmune serum-reactive antigen (or an antigenic fragment thereof) is recognized by at least 10 individual antibody preparations, preferably at least 30, especially at least 50 individual antibody preparations, identification of the hyperimmune serum-reactive antigen is also selective enough for a proper identification. Hyperimmune serum-reactivity may of course be tested with as many individual preparations as possible (e.g. with more than 100 or even with more than 1,000).

Therefore, the relevant portion of the hyperimmune serum-reactive antibody preparations according to the method of the present invention should preferably be at least 10, more preferred at least 30, especially at least 50 individual antibody preparations. Alternatively (or in combination) hyperimmune serum-reactive antigens may preferably be also identified with at least 20%, preferably at least 30%, especially at least 40% of all individual antibody preparations used in the second screening round.

According to a preferred embodiment of the present invention, the sera from which the individual antibody preparations for the second round of screening are prepared (or which are used as antibody preparations), are selected by their titer against S. agalactiae (e.g. against a preparation of this pathogen, such as a lysate, cell wall components and recombinant proteins). Preferably, some are selected with a total IgA titer above 300 U, especially above 500 U, and/or an IgG titer above 5,000 U, especially above 10,000 U (U=units, calculated from the $OD_{405\,nm}$ reading at a given dilution) when the whole organism (total lysate or whole cells) is used as antigen in the ELISA.

The antibodies produced against streptococci by the human immune system and present in human sera are indicative of the in vivo expression of the antigenic proteins and their immunogenicity. The recognition of linear epitopes recognized by serum antibodies can be based on sequences as short as 4-5 amino acids. Of course it does not necessarily mean that these short peptides are capable of inducing the given antibody in vivo. For that reason the defined epitopes, polypeptides and proteins are further to be tested in animals (mainly in mice) for their capacity to induce antibodies against the selected proteins in vivo.

The preferred antigens are located on the cell surface or secreted, and are therefore accessible extracellularly. Antibodies against cell wall proteins are expected to serve multiple purposes: to inhibit adhesion, to interfere with nutrient acquisition, to inhibit immune evasion nand to promote phagocytosis {Hornef, M. et al., 2002}. Antibodies against secreted proteins are beneficial in neutralisation of their function as toxin or virulence component. It is also known that bacteria communicate with each other through secreted proteins. Neutralizing antibodies against these proteins will interrupt growth-promoting cross-talk between or within streptococcal species. Bioinformatic analyzes (signal sequences, cell wall localisation signals, transmembrane domains) proved to be very useful in assessing cell surface localisation or secretion. The experimental approach includes the isolation of antibodies with the corresponding epitopes and proteins from human serum, and the generation of immune sera in mice against (poly) peptides selected by the bacterial surface display screens. These sera are then used in a third round of screening as reagents in the following assays: cell surface staining of S. agalactiae grown under different conditions (FACS or microscopy), determination of neutralizing capacity (toxin, adherence), and promotion of opsonization and phagocytosis (in vitro phagocytosis assay).

For that purpose, bacterial E. coli clones are directly injected into mice and immune sera are taken and tested in the relevant in vitro assay for functional opsonic or neutralizing antibodies. Alternatively, specific antibodies may be purified from human or mouse sera using peptides or proteins as substrate.

Host defence against S. agalactiae relies mainly on opsonophagocytic killing mechanism. Inducing high affinity antibodies of the opsonic and neutralizing type by vaccination helps the innate immune system to eliminate bacteria and toxins. This makes the method according to the present invention an optimal tool for the identification of GBS antigenic proteins.

The skin and mucous membranes are formidable barriers against invasion by streptococci. However, once the skin or the mucous membranes are breached the first line of non-adaptive cellular defence begins its co-ordinate action through complement and phagocytes, especially the polymorphonuclear leukocytes (PMNs). These cells can be regarded as the cornerstones in eliminating invading bacteria. As Streptococcus agalactiae is a primarily extracellular pathogen, the major anti-streptococcal adaptive response comes from the humoral arm of the immune system, and is mediated through three major mechanisms: promotion of opsonization, toxin neutralisation, and inhibition of adherence. It is believed that opsonization is especially important, because of its requirement for an effective phagocytosis. For efficient opsonization the microbial surface has to be coated with antibodies and complement factors for recognition by PMNs through receptors to the Fc fragment of the IgG molecule or to activated C3b. After opsonization, streptococci are phagocytosed and killed. Antibodies bound to specific antigens on the cell surface of bacteria serve as ligands for the attachment to PMNs and to promote phagocytosis. The very same antibodies bound to the adhesins and other cell surface proteins are expected to neutralize adhesion and prevent colonization. The selection of antigens as provided by the present invention is thus well suited to identify those that will lead to protection against infection in an animal model or in humans.

According to the antigen identification method used herein, the present invention can surprisingly provide a set of comprehensive novel nucleic acids and novel hyperimmune serum reactive antigens and fragments thereof of S. agalactiae, among other things, as described below. According to one aspect, the invention particularly relates to the nucleotide sequences encoding hyperimmune serum reactive antigens which sequences are set forth in the Sequence listing Seq ID No: 1-217, 435-448 and 463-474 and the corresponding encoded amino acid sequences representing hyperimmune serum reactive antigens are set forth in the Sequence Listing Seq ID No 218-434, 449-462 and 475-486.

In a preferred embodiment of the present invention, a nucleic acid molecule is provided which exhibits 70% identity over their entire length to a nucleotide sequence set forth with Seq ID No 14, 90, 157-216. Most highly preferred are nucleic acids that comprise a region that is at least 80% or at least 85% identical over their entire length to a nucleic acid molecule set forth with Seq ID No 14, 90, 157-216. In this regard, nucleic acid molecules at least 90%, 91%, 92%, 93%, 94%, 95%, or 96% identical over their entire length to the same are particularly preferred. Furthermore, those with at least 97% are highly preferred, those with at least 98% and at least 99% are particularly highly preferred, with at least 99% or 99.5% being the more preferred, with 100% identity being especially preferred. Moreover, preferred embodiments in this respect are nucleic acids which encode hyperimmune serum reactive antigens or fragments thereof (polypeptides) which retain substantially the same biological function or activity as the mature polypeptide encoded by said nucleic acids set forth in the Seq ID No 14, 90, 157-216.

Identity, as known in the art and used herein, is the relationship between two or more polypeptide sequences or two or more polynucleotide sequences, as determined by comparing the sequences. In the art, identity also means the degree of sequence relatedness between polypeptide or polynucleotide sequences, as the case may be, as determined by the match between strings of such sequences. Identity can be readily calculated. While there exist a number of methods to measure identity between two polynucleotide or two polypeptide sequences, the term is well known to skilled artisans (e.g. *Sequence Analysis in Molecular Biology*, von Heinje, G., Academic Press, 1987). Preferred methods to determine identity are designed to give the largest match between the sequences tested. Methods to determine identity are codified in computer programs. Preferred computer program methods to determine identity between two sequences include, but are not limited to, GCG program package {Devereux, J. et al., 1984}, BLASTP, BLASTN, and FASTA {Altschul, S. et al., 1990}.

According to another aspect of the invention, nucleic acid molecules are provided which exhibit 96% or more than 96%, especially 100% sequence identity to the nucleic acid sequence set forth with Seq ID No 1, 3, 5-13, 15, 18-25, 27-31, 33-36, 39-68, 70-85, 92-100, 103-126, 128-145, 147, 149-156, 217, 435-448 and 463-474.

According to a further aspect of the present invention, nucleic acid molecules having 98% or more than 98%, especially 100% sequence identity to a nucleic acid molecule are provided which are identical to the nucleic acid sequences set forth with Seq ID No 32, 86, 91, 101, 127.

The nucleic acid molecules according to the present invention can as a second alternative also be a nucleic acid molecule which is at least essentially complementary to the nucleic acid described as the first alternative above. As used herein complementary means that a nucleic acid strand is base pairing via Watson-Crick base pairing with a second nucleic acid strand. Essentially complementary as used herein means that the base pairing is not occurring for all of the bases of the respective strands but leaves a certain number or percentage of the bases unpaired or wrongly paired. The percentage of correctly pairing bases is preferably at least 70%, more preferably 80%, even more preferably 90% and most preferably any percentage higher than 90%. It is to be noted that a percentage of 70% matching bases is considered as homology and the hybridization having this extent of matching base pairs is considered as stringent. Hybridization conditions for this kind of stringent hybridization may be taken from Current Protocols in Molecular Biology (John Wiley and Sons, Inc., 1987). More particularly, the hybridization conditions can be as follows:

Hybridization performed e.g. in 5×SSPE, 5×Denhardt's reagent, 0.1% SDS, 100 g/mL sheared DNA at 68° C.
Moderate stringency wash in 0.2×SSC, 0.1% SDS at 42° C.
High stringency wash in 0.1×SSC, 0.1% SDS at 68° C.
Genomic DNA with a GC content of 50% has an approximate $T_M$ of 96° C. For 1% mismatch, the $T_M$ is reduced by approximately 1° C.

In addition, any of the further hybridization conditions described herein are in principle applicable as well.

Of course, all nucleic acid sequence molecules which encode the same polypeptide molecule as those identified by the present invention are encompassed by any disclosure of a given coding sequence, since the degeneracy of the genetic code is directly applicable to unambiguously determine all possible nucleic acid molecules which encode a given polypeptide molecule, even if the number of such degenerated nucleic acid molecules may be high. This is also applicable for fragments of a given polypeptide, as long as the fragments encode a polypeptide being suitable to be used in a vaccination connection, e.g. as an active or passive vaccine.

The nucleic acid molecule according to the present invention can as a third alternative also be a nucleic acid which comprises a stretch of at least 15 bases of the nucleic acid molecule according to the first and second alternative of the nucleic acid molecules according to the present invention as outlined above. Preferably, the bases form a contiguous stretch of bases. However, it is also within the scope of the present invention that the stretch consists of two or more moieties, which are separated by a number of bases.

The present nucleic acids may preferably consist of at least 20, even more preferred at least 30, especially at least 50 contiguous bases from the sequences disclosed herein. The suitable length may easily be optimized due to the planned area of use (e.g. as (PCR) primers, probes, capture molecules (e.g. on a (DNA) chip), etc.). Preferred nucleic acid molecules contain at least a contiguous 15 base portion of one or more of the predicted immunogenic amino acid sequences listed in tables 1 and 2, especially the sequences of table 2 with scores of more than 10, preferably more than 20, especially with a score of more than 25. Specifically preferred are nucleic acids containing a contiguous portion of a DNA sequence of any sequence in the sequence protocol of the present application which shows 1 or more, preferably more than 2, especially more than 5, non-identical nucleic acid residues compared to the published *Streptococcus agalactiae* strain NEM316 (ATCC 12403) genome ({Glaser, P. et al., 2002}; GenBank accession AL732656) and/or any other published *S. agalactiae* genome sequence or parts thereof, especially of the serotype V 2603 V/R (A909) strain {Tettelin, H. et al., 2002}); GenBank accession AE009948). Specifically preferred non-identical nucleic acid residues are residues, which lead to a non-identical amino acid residue. Preferably, the nucleic acid sequences encode polypeptides having at least 1, preferably at least 2, preferably at least 3 different amino acid residues compared to the published *S. agalactiae* counterparts mentioned above. Also such isolated polypeptides, being fragments of the proteins (or the whole protein) mentioned herein e.g. in the sequence listing, having at least 6, 7, or 8 amino acid residues and being encoded by these nucleic acids are preferred.

The nucleic acid molecule according to the present invention can as a fourth alternative also be a nucleic acid molecule which anneals under stringent hybridisation conditions to any of the nucleic acids of the present invention according to the above outlined first, second, and third alternative. Stringent hybridisation conditions are typically those described herein.

Finally, the nucleic acid molecule according to the present invention can as a fifth alternative also be a nucleic acid molecule which, but for the degeneracy of the genetic code, would hybridize to any of the nucleic acid molecules according to any nucleic acid molecule of the present invention according to the first, second, third, and fourth alternative as outlined above. This kind of nucleic acid molecule refers to the fact that preferably the nucleic acids according to the present invention code for the hyperimmune serum reactive antigens or fragments thereof according to the present invention. This kind of nucleic acid molecule is particularly useful in the detection of a nucleic acid molecule according to the present invention and thus the diagnosis of the respective microorganisms such as *S. agalactiae* and any disease or diseased condition where this kind of microorganims is involved. Preferably, the hybridisation would occur or be preformed under stringent conditions as described in connection with the fourth alternative described above.

Nucleic acid molecule as used herein generally refers to any ribonucleic acid molecule or deoxyribonucleic acid molecule, which may be unmodified RNA or DNA or modified RNA or DNA. Thus, for instance, nucleic acid molecule as used herein refers to, among other, single-and double-stranded DNA, DNA that is a mixture of single- and double-stranded RNA, and RNA that is a mixture of single- and double-stranded regions, hybrid molecules comprising DNA and RNA that may be single-stranded or, more typically, double-stranded, or triple-stranded, or a mixture of single- and double-stranded regions. In addition, nucleic acid molecule as used herein refers to triple-stranded regions comprising RNA or DNA or both RNA and DNA. The strands in such regions may be from the same molecule or from different molecules. The regions may include all of one or more of the molecules, but more typically involve only a region of some of the molecules. One of the molecules of a triple-helical region often is an oligonucleotide. As used herein, the term nucleic acid molecule includes DNAs or RNAs as described above that contain one or more modified bases. Thus, DNAs or RNAs with backbones modified for stability or for other reasons are "nucleic acid molecule" as that term is intended herein. Moreover, DNAs or RNAs comprising unusual bases, such as inosine, or modified bases, such as tritylated bases, to name just two examples, are nucleic acid molecule as the term is used herein. It will be appreciated that a great variety of modifications have been made to DNA and RNA that serve many useful purposes known to those of skill in the art. The term nucleic acid molecule as it is employed herein embraces such chemically, enzymatically or metabolically modified forms of nucleic acid molecule, as well as the chemical forms of DNA and RNA characteristic of viruses and cells, including simple and complex cells, inter alia. The term nucleic acid molecule also embraces short nucleic acid molecules often referred to as oligonucleotide(s). "Polynucleotide" and "nucleic acid" or "nucleic acid molecule" are often used interchangeably herein.

Nucleic acid molecules provided in the present invention also encompass numerous unique fragments, both longer and shorter than the nucleic acid molecule sequences set forth in the sequencing listing of the *S. agalactiae* coding regions, which can be generated by standard cloning methods. To be unique, a fragment must be of sufficient size to distinguish it from other known nucleic acid sequences, most readily determined by comparing any selected *S. agalactiae* fragment to the nucleotide sequences in computer databases such as Gen-Bank.

Additionally, modifications can be made to the nucleic acid molecules and polypeptides that are encompassed by the present invention. For example, nucleotide substitutions can be made which do not affect the polypeptide encoded by the nucleic acid, and thus any nucleic acid molecule which encodes a hyperimmune serum reactive antigen or fragments thereof is encompassed by the present invention.

Furthermore, any of the nucleic acid molecules encoding hyperimmune serum reactive antigens or fragments thereof provided by the present invention can be functionally linked, using standard techniques such as standard cloning techniques, to any desired regulatory sequences, whether a *S. agalactiae* regulatory sequence or a heterologous regulatory sequence, heterologous leader sequence, heterologous marker sequence or a heterologous coding sequence to create a fusion protein.

Nucleic acid molecules of the present invention may be in the form of RNA, such as mRNA or cRNA, or in the form of DNA, including, for instance, cDNA and genomic DNA obtained by cloning or produced by chemical synthetic techniques or by a combination thereof. The DNA may be triple-stranded, double-stranded or single-stranded. Single-stranded DNA may be the coding strand, also known as the sense strand, or it may be the non-coding strand, also referred to as the anti-sense strand.

The present invention further relates to variants of the herein above described nucleic acid molecules which encode fragments, analogs and derivatives of the hyperimmune serum reactive antigens and fragments thereof having a deducted *S. agalactiae* amino acid sequence set forth in the Sequence Listing. A variant of the nucleic acid molecule may be a naturally occurring variant such as a naturally occurring allelic variant, or it may be a variant that is not known to occur naturally. Such non-naturally occurring variants of the nucleic acid molecule may be made by mutagenesis techniques, including those applied to nucleic acid molecules, cells or organisms.

Among variants in this regard are variants that differ from the aforementioned nucleic acid molecules by nucleotide substitutions, deletions or additions. The substitutions, deletions or additions may involve one or more nucleotides. The variants may be altered in coding or non-coding regions or both. Alterations in the coding regions may produce conservative or non-conservative amino acid substitutions, deletions or additions. Preferred are nucleic acid molecules encoding a variant, analog, derivative or fragment, or a variant, analogue or derivative of a fragment, which have a *S. agalactiae* sequence as set forth in the Sequence Listing, in which several, a few, 5 to 10, 1 to 5, 1 to 3, 2, 1 or no amino acid(s) is substituted, deleted or added, in any combination. Especially preferred among these are silent substitutions, additions and deletions, which do not alter the properties and activities of the *S. agalactiae* polypeptides set forth in the Sequence Listing. Also especially preferred in this regard are conservative substitutions.

The peptides and fragments according to the present invention also include modified epitopes wherein preferably one or two of the amino acids of a given epitope are modified or replaced according to the rules disclosed in e.g. {Tourdot, S. et al., 2000}, as well as the nucleic acid sequences encoding such modified epitopes.

It is clear that also epitopes derived from the present epitopes by amino acid exchanges improving, conserving or at least not significantly impeding the T cell activating capability of the epitopes are covered by the epitopes according to the present invention. Therefore the present epitopes also cover epitopes, which do not contain the original sequence as derived from *S. agalactiae*, but trigger the same or preferably an improved T cell response. These epitope are referred to as "heteroclitic"; they need to have a similar or preferably greater affinity to MHC/HLA molecules, and the need the ability to stimulate the T cell receptors (TCR) directed to the original epitope in a similar or preferably stronger manner.

Heteroclitic epitopes can be obtained by rational design i.e. taking into account the contribution of individual residues to binding to MHC/HLA as for instance described by {Rammensee, H. et al., 1999}, combined with a systematic exchange of residues potentially interacting with the TCR and testing the resulting sequences with T cells directed against the original epitope. Such a design is possible for a skilled man in the art without much experimentation.

Another possibility includes the screening of peptide libraries with T cells directed against the original epitope. A preferred way is the positional scanning of synthetic peptide libraries. Such approaches have been described in detail for instance by {Hemmer, B. et al., 1999} and the references given therein.

As an alternative to epitopes represented by the present derived amino acid sequences or heteroclitic epitopes, also substances mimicking these epitopes e.g. "peptidemimetica" or "retro-inverso-peptides" can be applied.

Another aspect of the design of improved epitopes is their formulation or modification with substances increasing their capacity to stimulate T cells. These include T helper cell epitopes, lipids or liposomes or preferred modifications as described in WO 01/78767.

Another way to increase the T cell stimulating capacity of epitopes is their formulation with immune stimulating substances for instance cytokines or chemokines like interleukin-2, -7, -12, -18, class I and II interferons (IFN), especially IFN-gamma, GM-CSF, TNF-alpha, flt3-ligand and others.

As discussed additionally herein regarding nucleic acid molecule assays of the invention, for instance, nucleic acid molecules of the invention as discussed above, may be used as a hybridization probe for RNA, cDNA and genomic DNA to isolate full-length cDNAs and genomic clones encoding polypeptides of the present invention and to isolate cDNA and genomic clones of other genes that have a high sequence similarity to the nucleic acid molecules of the present invention. Such probes generally will comprise at least 15 bases. Preferably, such probes will have at least 20, at least 25 or at least 30 bases, and may have at least 50 bases. Particularly preferred probes will have at least 30 bases, and will have 50 bases or less, such as 30, 35, 40, 45, or 50 bases.

For example, the coding region of a nucleic acid molecule of the present invention may be isolated by screening a relevant library using the known DNA sequence to synthesize an oligonucleotide probe. A labeled oligonucleotide having a sequence complementary to that of a gene of the present invention is then used to screen a library of cDNA, genomic DNA or mRNA to determine to which members of the library the probe hybridizes.

The nucleic acid molecules and polypeptides of the present invention may be employed as reagents and materials for development of treatments of and diagnostics for disease, particularly human disease, as further discussed herein relating to nucleic acid molecule assays, inter alia.

The nucleic acid molecules of the present invention that are oligonucleotides can be used in the processes herein as described, but preferably for PCR, to determine whether or not the *S. agalactiae* genes identified herein in whole or in part are present and/or transcribed in infected tissue such as blood. It is recognized that such sequences will also have utility in diagnosis of the stage of infection and type of infection the pathogen has attained. For this and other purposes the arrays comprising at least one of the nucleic acids according to the present invention as described herein, may be used.

The nucleic acid molecules according to the present invention may be used for the detection of nucleic acid molecules and organisms or samples containing these nucleic acids. Preferably such detection is for diagnosis, more preferable for the diagnosis of a disease related or linked to the present or abundance of *S. agalactiae*.

Eukaryotes (herein also "individual(s)"), particularly mammals, and especially humans, infected with *S. agalactiae* may be identifiable by detecting any of the nucleic acid molecules according to the present invention detected at the DNA level by a variety of techniques. Preferred nucleic acid molecules candidates for distinguishing a *S. agalactiae* from other organisms can be obtained.

The invention provides a process for diagnosing disease, arising from infection with *S. agalactiae*, comprising determining from a sample isolated or derived from an individual an increased level of expression of a nucleic acid molecule having the sequence of a nucleic acid molecule set forth in the Sequence Listing. Expression of nucleic acid molecules can be measured using any one of the methods well known in the art for the quantitation of nucleic acid molecules, such as, for example, PCR, RT-PCR, Rnase protection, Northern blotting, other hybridisation methods and the arrays described herein.

Isolated as used herein means separated "by the hand of man" from its natural state; i.e., that, if it occurs in nature, it has been changed or removed from its original environment, or both. For example, a naturally occurring nucleic acid molecule or a polypeptide naturally present in a living organism in its natural state is not "isolated," but the same nucleic acid molecule or polypeptide separated from the coexisting materials of its natural state is "isolated", as the term is employed herein. As part of or following isolation, such nucleic acid molecules can be joined to other nucleic acid molecules, such as DNAs, for mutagenesis, to form fusion proteins, and for propagation or expression in a host, for instance. The isolated nucleic acid molecules, alone or joined to other nucleic acid molecules such as vectors, can be introduced into host cells, in culture or in whole organisms. Introduced into host cells in culture or in whole organisms, such DNAs still would be isolated, as the term is used herein, because they would not be in their naturally occurring form or environment. Similarly, the nucleic acid molecules and polypeptides may occur in a composition, such as a media formulations, solutions for introduction of nucleic acid molecules or polypeptides, for example, into cells, compositions or solutions for chemical or enzymatic reactions, for instance, which are not naturally occurring compositions, and, therein remain isolated nucleic acid molecules or polypeptides within the meaning of that term as it is employed herein.

The nucleic acids according to the present invention may be chemically synthesized. Alternatively, the nucleic acids can be isolated from *S. agalactiae* by methods known to the one skilled in the art.

According to another aspect of the present invention, a comprehensive set of novel hyperimmune serum reactive antigens and fragments thereof are provided by using the herein described antigen identification method. In a preferred embodiment of the invention, a hyperimmune serum-reactive antigen comprising an amino acid sequence being encoded by any one of the nucleic acids molecules herein described and fragments thereof are provided. In another preferred embodiment of the invention a novel set of hyperimmune serum-reactive antigens which comprises amino acid sequences selected from a group consisting of the polypeptide sequences as represented in Seq ID No 231, 307, 374-433 and fragments thereof are provided. In a further preferred embodiment of the invention hyperimmune serum-reactive antigens which comprise amino acid sequences selected from a group consisting of the polypeptide sequences as represented in Seq ID No 218, 220, 222-230, 232, 235-242, 244-248, 250-253, 256-285, 287-302, 309-317, 320-343, 345-362, 364, 366-373, 434, 449-462 and 475-486 and fragments thereof are provided. In a still preferred embodiment of the invention hyperimmune serum-reactive antigens which comprise amino acid sequences selected from a group consisting of the polypeptide sequences as represented in Seq ID No 249, 303, 308, 318, 344 and fragments thereof are provided. The hyperimmune serum reactive antigens and fragments thereof as provided in the invention include any polypeptide set forth in the Sequence Listing as well as polypeptides which have at least 70% identity to a polypeptide set forth in the Sequence Listing, preferably at least 80% or 85% identity to a polypeptide set forth in the Sequence Listing, and more preferably at least 90% similarity (more preferably at least 90% identity) to a polypeptide set forth in the Sequence Listing and still more preferably at least 95%, 96%, 97%, 98%, 99% or 99.5% similarity (still more preferably at least 95%, 96%, 97%, 98%, 99%, or 99.5% identity) to a polypeptide set forth in the Sequence Listing and also include portions of such polypeptides with such portion of the polypeptide generally containing at least 4 amino acids and more preferably at least 8, still more preferably at least 30, still more preferably at least 50 amino acids, such as 4, 8, 10, 20, 30, 35, 40, 45 or 50 amino acids.

The invention also relates to fragments, analogs, and derivatives of these hyperimmune serum reactive antigens and fragments thereof. The terms "fragment", "derivative" and "analog" when referring to an antigen whose amino acid sequence is set forth in the Sequence Listing, means a polypeptide which retains essentially the same or a similar biological function or activity as such hyperimmune serum reactive antigen and fragment thereof.

The fragment, derivative or analog of a hyperimmune serum reactive antigen and fragment thereof may be 1) one in which one or more of the amino acid residues are substituted with a conserved or non-conserved amino acid residue (preferably a conserved amino acid residue) and such substituted amino acid residue may or may not be one encoded by the genetic code, or 2) one in which one or more of the amino acid residues includes a substituent group, or 3) one in which the mature hyperimmune serum reactive antigen or fragment thereof is fused with another compound, such as a compound to increase the half-life of the hyperimmune serum reactive antigen and fragment thereof (for example, polyethylene glycol), or 4) one in which the additional amino acids are fused to the mature hyperimmune serum reactive antigen or fragment thereof, such as a leader or secretory sequence or a sequence which is employed for purification of the mature hyperimmune serum reactive antigen or fragment thereof or a proprotein sequence. Such fragments, derivatives and analogs are deemed to be within the scope of those skilled in the art from the teachings herein.

The present invention also relates to antigens of different *S. agalactiae* isolates. Such homologues may easily be isolated based on the nucleic acid and amino acid sequences disclosed herein. There are 9 serotypes distinguished to date and the typing is based on serotype specific antisera. The presence of any antigen can accordingly be determined for every serotype. In addition it is possible to determine the variability of a particular antigen in the various serotypes as described for the *S. pyogenes* sic gene {Hoe, N. et al., 2001}. The contribution of the various serotypes to the different GBS infections varies in the different age groups and geographical regions. It is an important aspect that the most valuable protective antigens are expected to be conserved among various clinical strains.

Among the particularly preferred embodiments of the invention in this regard are the hyperimmune serum reactive antigens set forth in the Sequence Listing, variants, analogs, derivatives and fragments thereof, and variants, analogs and derivatives of fragments. Additionally, fusion polypeptides comprising such hyperimmune serum reactive antigens, variants, analogs, derivatives and fragments thereof, and variants, analogs and derivatives of the fragments are also encompassed by the present invention. Such fusion polypeptides and proteins, as well as nucleic acid molecules encoding them, can readily be made using standard techniques, including standard recombinant techniques for producing and expression of a recombinant polynucleic acid encoding a fusion protein.

Among preferred variants are those that vary from a reference by conservative amino acid substitutions. Such substitutions are those that substitute a given amino acid in a polypeptide by another amino acid of like characteristics. Typically seen as conservative substitutions are the replacements, one for another, among the aliphatic amino acids Ala, Val, Leu and Ile; interchange of the hydroxyl residues Ser and Thr, exchange of the acidic residues Asp and Glu, substitution between the amide residues Asn and Gln, exchange of the basic residues Lys and Arg and replacements among the aromatic residues Phe and Tyr.

Further particularly preferred in this regard are variants, analogs, derivatives and fragments, and variants, analogs and derivatives of the fragments, having the amino acid sequence of any polypeptide set forth in the Sequence Listing, in which several, a few, 5 to 10, 1 to 5, 1 to 3, 2, 1 or no amino acid residues are substituted, deleted or added, in any combination. Especially preferred among these are silent substitutions, additions and deletions, which do not alter the properties and activities of the polypeptide of the present invention. Also especially preferred in this regard are conservative substitutions. Most highly preferred are polypeptides having an amino acid sequence set forth in the Sequence Listing without substitutions.

The hyperimmune serum reactive antigens and fragments thereof of the present invention are preferably provided in an isolated form, and preferably are purified to homogeneity.

Also among preferred embodiments of the present invention are polypeptides comprising fragments of the polypeptides having the amino acid sequence set forth in the Sequence Listing, and fragments of variants and derivatives of the polypeptides set forth in the Sequence Listing.

In this regard a fragment is a polypeptide having an amino acid sequence that entirely is the same as part but not all of the amino acid sequence of the afore mentioned hyperimmune serum reactive antigen and fragment thereof, and variants or derivative, analogs, fragments thereof. Such fragments may be “free-standing”, i.e., not part of or fused to other amino acids or polypeptides, or they may be comprised within a larger polypeptide of which they form a part or region. Also preferred in this aspect of the invention are fragments characterised by structural or functional attributes of the polypeptide of the present invention, i.e. fragments that comprise alpha-helix and alpha-helix forming regions, beta-sheet and beta-sheet forming regions, turn and turn-forming regions, coil and coil-forming regions, hydrophilic regions, hydrophobic regions, alpha amphipathic regions, beta-amphipathic regions, flexible regions, surface-forming regions, substrate binding regions, and high antigenic index regions of the polypeptide of the present invention, and combinations of such fragments. Preferred regions are those that mediate activities of the hyperimmune serum reactive antigens and fragments thereof of the present invention. Most highly preferred in this regard are fragments that have a chemical, biological or other activity of the hyperimmune serum reactive antigen and fragments thereof of the present invention, including those with a similar activity or an improved activity, or with a decreased undesirable activity. Particularly preferred are fragments comprising receptors or domains of enzymes that confer a function essential for viability of *S. agalactiae* or the ability to cause disease in humans. Further preferred polypeptide fragments are those that comprise or contain antigenic or immunogenic determinants in an animal, especially in a human.

An antigenic fragment is defined as a fragment of the identified antigen, which is for itself antigenic or may be made antigenic when provided as a hapten. Therefore, also antigens or antigenic fragments showing one or (for longer fragments) only a few amino acid exchanges are enabled with the present invention, provided that the antigenic capacities of such fragments with amino acid exchanges are not severely deteriorated on the exchange(s), i.e., suited for eliciting an appropriate immune response in an individual vaccinated with this antigen and identified by individual antibody preparations from individual sera.

Preferred examples of such fragments of hyperimmune serum-reactive antigens selected from the group consisting of peptides comprising amino acid sequences of column "predicted immunogenic aa" and "location of identified immunogenic region" of Table 1A, especially peptides comprising amino acid 4-20, 35-44, 65-70, 73-87, 92-98, 112-137, 152-161, 177-186, 193-200, 206-213, 229-255, 282-294, 308-313, 320-326, 349-355, 373-384, 388-406, 420-425 and 115-199 of Seq ID No 218; 5-24, 35-41, 44-70, 73-89, 103-109, 127-143, 155-161, 185-190, 192-207, 212-219, 246-262, 304-336, 372-382, 384-393, 398-407, 412-418, 438-444, 1-75, 76-161 and 164-239 of Seq ID No 219; 4-10, 16-58, 60-71, 77-92, 100-126, 132-146, 149-164, 166-172, 190-209, 214-220, 223-229, 241-256, 297-312, 314-319, 337-343, 351-359, 378-387, 398-418, 421-428, 430-437, 440-448, 462-471, 510-519, 525-536, 552-559, 561-568, 573-582, 596-602, 608-630, 637-649, 651-665, 681-702, 714-732, 739-745, 757-778, 790-805, 807-815, 821-829, 836-842, 846-873, 880-903, 908-914, 916-923, 931-940, 943-948, 956-970, 975-986, 996-1015, 1031-1040, 1051-1069, 1072-1095, 1114-1119, 1130-1148, 1150-1157, 1169-1176, 1229-1238 and 802-812 of Seq ID No 220; 5-12, 14-26, 35-47, 52-67, 72-78, 83-98, 121-141, 152-159, 163-183, 186-207, 209-257, 264-277, 282-299, 301-309, 312-318, 324-339, 358-368, 372-378, 387-397, 425-431 and 46-291 of Seq ID No 221; 29-38, 44-64, 70-76, 78-87, 94-100, 102-112, 119-134, 140-149, 163-173, 178-186, 188-194, 207-234, 247-262, 269-290 and 73-92 of Seq ID No 222; 10-28, 36-63, 77-87, 103-119, 127-136, 141-169, 171-183, 195-200, 207-232, 236-246, 251-265, 268-283, 287-297, 314-322, 335-343, 354-363, 384-390, 405-411, 419-436, 443-455, 467-473, 480-513, 518-529, 550-557, 565-585, 602-608, 616-625, 632-660, 665-677, 685-701, 726-736, 738-747, 752-761, 785-796, 801-813, 838-853, 866-871 and 757-774 of Seq ID No 223; 31-38, 61-66, 74-81, 90-115, 123-145, 154-167, 169-179, 182-193, 200-206, 238-244, 267-272 and 235-251 of Seq ID No 224; 19-25, 38-54, 56-64, 66-72, 74-92, 94-100, 116-129, 143-149, 156-183, 204-232, 253-266, 269-275, 294-307 and 241-313 of Seq ID No 225; 5-34, 50-56, 60-65, 74-85, 89-97, 108-119, 159-165, 181-199, 209-225, 230-240, 245-251, 257-262, 274-282, 300-305 and 64-75 of Seq ID No 226; 5-13, 16-21, 27-42, 45-52, 58-66, 74-87, 108-114, 119-131 and 39-51 of Seq ID No 227; 6-23, 46-54, 59-65, 78-84, 100-120, 128-133, 140-146, 159-165, 171-183, 190-204, 224-232, 240-248, 250-259, 274-280, 288-296, 306-315 and 267-274 of Seq ID No 228; 5-12, 15-24, 26-36, 42-65, 68-80, 82-104, 111-116, 125-144, 159-167, 184-189, 209-218, 235-243, 254-265, 269-283, 287-300, 306-316, 318-336, 338-352, 374-392 and 162-174 of Seq ID No 229; 30-42, 45-54 and 25-37 of Seq ID No 230; 10-30, 53-59, 86-95, 116-130, 132-147, 169-189, 195-201, 212-221, 247-256, 258-265, 278-283, 291-298, 310-316, 329-339, 341-352, 360-367, 388-396, 398-411, 416-432, 443-452, 460-466, 506-512, 515-521, 542-548 and 419-431 of Seq ID No 231; 4-27, 30-53, 60-67, 70-90, 92-151, 159-185, 189-195, 198-210, 215-239 and 173-189 of Seq ID No 232; 4-26, 41-54, 71-78, 116-127, 140-149, 151-158, 161-175, 190-196, 201-208, 220-226, 240-252, 266-281, 298-305, 308-318, 321-329, 344-353, 372-378, 384-405, 418-426, 429-442, 457-463, 494-505, 514-522 and 174-188 of Seq ID No 233; 17-25, 27-39, 61-67, 81-89, 99-110, 120-131, 133-139, 147-161, 167-172, 179-185, 192-198, 203-213, 226-238, 243-258, 261-267, 284-290, 296-307, 311-328, 340-352, 356-371 and 239-256 of Seq ID No 234; 8-30, 40-49, 67-80, 114-123, 126-142, 152-162, 188-194 and 57-70 of Seq ID No 235; 4-23, 28-34, 36-47, 50-61, 76-81, 89-94, 96-104, 112-119, 126-146, 155-181, 195-200, 208-214, 220-229, 244-260, 263-276, 282-288, 292-300, 317-323, 336-351, 353-359, 363-375, 382-399, 415-432, 444-455, 458-471, 476-481, 484-492, 499-517, 522-529, 535-541, 543-568, 572-584, 586-600, 607-617, 626-637, 656-675 and 282-297 of Seq ID No 236; 6-24, 30-35, 38-45, 63-91, 134-140, 146-160, 167-188, 214-220, 226-234, 244-250, 260-270, 286-301, 316-329, 340-371, 429-446, 448-459, 474-481, 485-491, 512-526, 537-544, 550-565, 573-583, 596-613, 621-630, 652-658 and 87-97 of Seq ID No 237; 8-20, 26-48, 56-67, 76-86, 94-109, 115-121, 123-129, 143-160, 178-186, 191-198, 201-208, 221-236, 238-244, 260-268 and 237-247 of Seq ID No 238; 4-40, 42-57, 73-87, 98-117, 126-135, 150-156, 166-174, 196-217, 231-236, 248-258, 276-284, 293-301, 307-313, 339-347, 359-365, 375-387, 395-402, 428-440, 445-456, 485-490, 497-505, 535-541, 547-555, 610-625, 648-656, 665-671 and 448-528 of Seq ID No 239; 10-18, 39-45, 51-61, 80-96, 98-106, 110-115, 158-172, 174-183, 191-200, 220-237, 249-255, 274-289, 308-324, 331-341, 372-381, 384-397, 405-414 and 322-338 of Seq ID No 240; 30-36, 38-56, 85-108, 134-147, 149-160, 163-183, 188-201, 206-211, 219-238, 247-254 and 5-13 of Seq ID No 241; 11-40, 98-103, 110-115, 133-145, 151-159, 172-179, 192-201, 204-212, 222-228, 235-245, 258-268, 283-296, 298-309, 322-329, 342-351, 354-362, 372-378, 385-393, 407-418, 495-516 and 1-148 of Seq ID No 242; 5-19, 21-36, 73-94, 112-119, 122-137, 139-145, 152-167, 184-190, 198-204, 208-224, 249-265, 267-281, 299-304, 309-317, 326-333, 356-364, 368-374, 381-389, 391-414, 419-425, 430-435 and 113-140 of Seq ID No 243; 45-54, 59-67, 78-91 and 15-23 of Seq ID No 244; 11-22, 33-47, 52-80, 88-112, 124-129 and 6-25 of Seq ID No 245; 26-41, 51-63, 80-89, 93-115, 150-163, 187-193, 220-237, 240-249, 286-294, 296-306, 316-329, 345-353, 361-370, 407-425, 428-437, 474-482, 484-494, 504-517, 533-541, 549-558, 595-613, 616-625, 660-668, 673-685, 711-726, 736-744, 749-761, 787-802, 812-820, 825-837, 863-878, 888-896, 901-913, 939-954, 964-972, 977-989, 1003-1008, 1016-1022, 1028-1034, 1041-1053, 1059-1074, 1101-1122, 420-511 and 581-704 of Seq ID No 246; 18-25, 27-55, 71-83, 89-95, 102-113, 120-146, 150-156, 174-185 and 159-175 of Seq ID No 247; 24-30, 38-56, 63-68, 87-93, 136-142, 153-164, 183-199, 213-219, 226-234, 244-261, 269-278, 283-289, 291-297, 320-328, 330-336, 340-346, 348-356, 358-366, 382-387, 401-408, 414-419, 449-455, 468-491, 504-512, 531-537, 554-560, 597-608, 621-627, 632-643, 650-662, 667-692, 703-716, 724-737, 743-758, 783-794, 800-818, 846-856 and 806-884 of Seq ID No 248; 4-14, 21-39, 86-92, 99-107, 121-131, 136-144, 147-154, 158-166, 176-185, 193-199, 207-222, 224-230 and 117-136 of Seq ID No 249; 65-76, 85-97, 103-109, 115-121, 125-146, 163-169, 196-205, 212-219, 228-237, 241-247, 254-262, 269-288, 294-303, 305-313, 328-367, 395-401, 405-412, 418-429, 437-447, 481-488, 506-513, 519-524, 530-541, 546-557 and 266-284 of Seq ID No 250; 5-14, 37-42, 49-71, 78-92, 97-112, 127-136, 147-154, 156-163, 186-198, 216-225, 233-243, 248-253, 295-307, 323-332, 359-366, 368-374, 380-398 and 194-223 of Seq ID No 251; 4-11, 33-39, 45-72, 100-113, 119-129, 136-144, 169-175, 177-185, 200-208, 210-219, 262-276, 278-297, 320-326, 336-344, 347-362, 381-394, 443-453 and 438-454 of Seq ID No 252; 4-29, 31-52, 55-61, 95-110, 138-158, 162-171, 179-187, 202-229, 239-248, 251-256, 262-267, 269-285, 304-310, 351-360, 362-368, 381-388, 415-428, 435-440, 448-458 and 161-178 of Seq ID No 253; 4-17, 19-28, 32-43, 47-59, 89-110, 112-126, 128-134, 140-148, 152-161, 169-184, 191-204, 230-235, 255-264, 328-338, 341-347, 401-409, 413-419, 433-441, 449-458, 463-468, 476-482, 486-492, 500-506, 529-545 and 305-381 of Seq ID No 254; 10-29, 38-45, 53-61, 134-145, 152-160, 163-170, 202-208, 219-229, 248-258, 266-275, 282-288, 315-320, 328-334, 377-385, 392-402, 418-424, 447-453, 460-471, 479-487, 491-497, 500-507, 531-537, 581-594, 615-623, 629-635, 644-652, 659-666, 668-678, 710-717, 719-728, 736-741, 747-760, 766-773, 784-789, 794-800, 805-817, 855-861, 866-887 and 698-715 of Seq ID No 255; 16-26, 29-37, 44-58, 62-68, 74-80, 88-95, 97-120, 125-144, 165-196 and 58-72 of Seq ID No 256; 14-21, 23-46, 49-60, 63-74, 78-92, 96-103, 117-129, 134-161, 169-211, 217-231, 239-248, 252-281, 292-299, 313-343 and 243-257 of Seq ID No 257; 11-27, 46-52, 67-72, 76-84, 91-112, 116-153, 160-175, 187-196, 202-211, 213-220 and 43-76 of Seq ID No 258; 5-29, 37-56, 78-86, 108-118, 152-161 and 120-130 of Seq ID No 259; 8-14, 19-41, 52-66, 75-82, 87-92, 106-121, 127-133, 136-143, 158-175, 180-187, 196-204, 221-228, 239-245, 259-265, 291-306, 318-323, 328-340, 352-358, 361-368, 375-381, 391-399, 411-418, 431-442, 446-455, 484-496, 498-510, 527-533, 541-549, 558-565, 575-585, 587-594, 644-655, 661-668, 671-677 and 184-196 of Seq ID No 260; 4-22, 29-38, 55-62, 75-81, 102-107, 110-134, 143-150, 161-167, 172-179, 191-215, 223-233, 241-247, 251-264, 266-272, 288-309, 340-352, 354-366, 394-402, 414-438 and 198-218 of Seq ID No 261; 24-44, 49-70, 80-91, 105-118, 128-136, 140-154 and 77-92 of Seq ID No 262; 5-22, 31-36, 41-47, 67-74, 83-90, 105-122, 135-143, 160-167 and 118-129 of Seq ID No 263; 4-25, 33-73, 81-93, 96-106, 114-120, 122-128, 130-172, 179-208, 210-241, 251-283, 296-301 and 92-100 of Seq ID No 264; 14-24, 29-38, 43-50, 52-72, 86-97, 101-107, 110-125, 127-141, 145-157, 168-175, 177-184, 186-195, 205-226, 238-250, 255-261, 284-290, 293-304, 307-314, 316-323, 325-356, 363-371, 383-390, 405-415, 423-432, 442-454, 466-485, 502-511, 519-527, 535-556, 558-565, 569-574, 612-634, 641-655, 672-686, 698-709, 715-722, 724-732, 743-753, 760-769, 783-792, 818-825, 830-839, 842-849, 884-896, 905-918, 926-940, 957-969, 979-1007, 1015-1021, 1049-1057 and 336-349 of Seq ID No 265; 6-16, 26-31, 33-39, 62-73, 75-85, 87-100, 113-123, 127-152, 157-164, 168-181, 191-198, 208-214, 219-226, 233-254, 259-266, 286-329 and 181-195 of Seq ID No 266; 4-13, 32-39, 53-76, 99-108, 110-116, 124-135, 137-146, 149-157, 162-174, 182-190, 207-231, 242-253, 255-264, 274-283, 291-323, 334-345, 351-360, 375-388, 418-425, 456-474, 486-492, 508-517, 520-536, 547-560, 562-577, 31-45 and 419-443 of Seq ID No 267; 15-26, 30-37, 42-49, 58-90, 93-99, 128-134, 147-154, 174-179, 190-197, 199-205, 221-230, 262-274, 277-287, 300-314, 327-333, 343-351, 359-377, 388-396, 408-413, 416-425, 431-446 and 246-256 of Seq ID No 268; 5-26, 34-42, 47-54, 61-67, 71-104, 107-115, 131-138, 144-153, 157-189, 196-202, 204-210, 228-245, 288-309, 316-329, 332-341, 379-386, 393-399, 404-412, 414-421, 457-468, 483-489, 500-506, 508-517, 523-534, 543-557, 565-580, 587-605, 609-617, 619-627, 631-636, 640-646, 662-668, 675-682, 705-710, 716-723, 727-732, 750-758, 784-789, 795-809, 869-874, 14-138, 166-286, 372-503, 674-696 and 754-859 of Seq ID No 269; 5-17, 32-38, 40-47, 80-89, 113-119, 125-137, 140-154, 157-163, 170-177, 185-199, 213-225, 228-236, 242-248, 277-290, 292-305, 323-333, 347-353, 364-370, 385-394, 399-406, 423-433, 441-451, 462-474, 477-487 and 116-124 of Seq ID No 270; 7-16, 18-30, 32-49, 53-61, 63-85, 95-101, 105-115, 119-134, 143-150, 159-178, 185-202, 212-229, 236-250, 254-265, 268-294 and 63-72 of Seq ID No 271; 4-12, 19-47, 73-81, 97-103, 153-169, 188-198, 207-213, 217-223, 236-242, 255-265, 270-278, 298-305, 309-317, 335-347, 354-363, 373-394, 419-424, 442-465, 486-492, 500-507, 542-549, 551-558, 560-572, 580-589, 607-614, 617-623, 647-653, 666-676, 694-704, 706-714, 748-754, 765-772, 786-792, 795-806 and 358-370 of Seq ID No 272; 18-28, 30-38, 40-46, 49-55, 69-78, 82-98, 104-134, 147-153, 180-190, 196-202, 218-236, 244-261, 266-273, 275-286, 290-295, 301-314, 378-387, 390-395, 427-434 and 290-305 of Seq ID No 273; 4-13, 20-31, 39-51, 54-61, 69-84, 87-105, 117-124 and 108-125 of Seq ID No 274; 24-34, 43-54, 56-66, 68-79 and 50-69 of Seq ID No 275; 5-43, 71-77, 102-131, 141-148, 150-156, 159-186, 191-207, 209-234, 255-268, 280-286, 293-299, 317-323, 350-357, 363-372, 391-397, 406-418, 428-435, 455-465, 484-497, 499-505, 525-531, 575-582, 593-607, 621-633, 638-649, 655-673, 684-698, 711-725, 736-741, 743-752, 759-769, 781-793, 813-831, 843-853, 894-905, 908-916, 929-946, 953-963, 970-978, 1001-1007, 1011-1033, 165-178 and 818-974 of Seq ID No 276; 16-44, 63-86, 98-108, 185-191, 222-237, 261-274, 282-294, 335-345, 349-362, 374-384, 409-420, 424-430, 440-447, 453-460, 465-473, 475-504, 522-534, 538-551, 554-560, 567-582, 598-607, 611-619, 627-640, 643-653, 655-661, 669-680, 684-690, 701-707, 715-731, 744-750, 756-763, 768-804, 829-837, 845-853, 855-879, 884-890, 910-928, 77-90, 144-212, 279-355, 434-536, 782-810 and 875-902 of Seq ID No 277; 4-22, 29-41, 45-51, 53-66, 70-77, 86-95, 98-104, 106-124, 129-135, 142-151, 153-161, 169-176, 228-251, 284-299, 331-337, 339-370, 380-387, 393-398, 406-411, 423-433, 440-452, 461-469, 488-498, 501-516, 523-530, 532-559, 562-567, 570-602, 612-628, 630-645, 649-659, 666-672, 677-696, 714-723, 727-747 and 212-227 of Seq ID No 278; 4-9, 17-31, 35-41, 56-61, 66-75, 81-87, 90-124, 133-138, 149-163, 173-192, 213-219, 221-262, 265-275, 277-282, 292-298, 301-307, 333-346, 353-363, 371-378, 419-430, 435-448, 456-469, 551-570, 583-599, 603-612 and 275-291 of Seq ID No 279; 28-34, 53-58, 72-81, 100-128, 145-154, 159-168, 172-189, 217-225, 227-249, 256-263, 299-309, 322-330, 361-379, 381-388, 392-401, 404-417, 425-436, 440-446, 451-464, 469-487, 502-511, 543-551, 559-564, 595-601, 606-612, 615-626, 633-642, 644-650, 664-670, 674-684, 692-701, 715-723, 726-734, 749-756, 763-771, 781-787, 810-843, 860-869, 882-889, 907-917, 931-936, 941-948, 951-958, 964-971, 976-993, 1039-1049, 1051-1065, 1092-1121, 1126-1132, 1145-1151, 1158-1173, 1181-1192, 1194-1208, 1218-1223, 1229-1243, 1249-1254, 1265-1279, 1287-1297, 1303-1320, 1334-1341, 1343-1358, 1372-1382, 1406-1417, 1419-1425, 1428-1434, 1441-1448, 1460-1473, 1494-1504, 1509-1514, 1529-1550, 654-669 and 1400-1483 of Seq ID No 280; 10-16, 20-25, 58-65, 97-109, 118-132, 134-146, 148-155, 186-195, 226-233, 244-262, 275-284, 295-310, 317-322, 330-339, 345-351, 366-375, 392-403, 408-415, 423-430, 435-444, 446-457, 467-479, 486-499, 503-510, 525-537, 540-585, 602-612, 614-623, 625-634, 639-645, 650-669, 700-707, 717-724, 727-739, 205-230 and 733-754 of Seq ID No 281; 5-22, 37-43, 72-81, 105-113, 128-133, 148-160, 188-194, 204-230, 238-245, 251-257 and 194-213 of Seq ID No 282; 16-21, 35-41, 56-72, 74-92, 103-109 and 62-68 of Seq ID No 283; 4-15, 17-82, 90-104, 107-159, 163-170, 188-221, 234-245, 252-265 and 220-235 of Seq ID No 284; 16-22, 36-46, 61-75, 92-107, 113-121, 139-145, 148-160 and 30-42 of Seq ID No 285; 4-12, 20-26, 43-49, 55-62, 66-78, 121-127, 135-141, 146-161, 164-170, 178-189, 196-205, 233-238, 269-279, 288-318, 325-332, 381-386, 400-407 and 328-346 of Seq ID No 286; 5-12, 31-49, 57-63, 69-79, 89-97, 99-114, 116-127, 134-142, 147-154, 160-173, 185-193, 199-204, 211-222, 229-236, 243-249, 256-274 and 58-68 of Seq ID No 287; 10-20, 28-34, 39-53, 68-79, 84-90, 99-106 and 73-79 of Seq ID No 288; 14-37, 45-50, 61-66, 77-82, 93-98, 109-114, 125-130, 141-146, 157-162, 173-178, 189-194, 205-210, 221-226, 237-242, 253-258, 269-274, 285-290, 301-306, 316-332, 349-359, 371-378, 385-406, 34-307 and 312-385 of Seq ID No 289; 4-10, 17-38, 50-85, 93-99, 109-116, 128-185, 189-197, 199-210, 223-256, 263-287, 289-312, 327-337, 371-386, 389-394, 406-419, 424-432, 438-450, 458-463, 475-502, 507-513, 519-526, 535-542, 550-567 and 361-376 of Seq ID No 290; 10-39, 42-93, 100-144, 155-176, 178-224, 230-244, 246-255, 273-282, 292-301, 308-325, 332-351, 356-361, 368-379, 386-393, 400-421 and 138-155 of Seq ID No 291; 5-11, 17-34, 40-45, 50-55, 72-80, 101-123, 145-151, 164-172, 182-187, 189-195, 208-218, 220-241, 243-252, 255-270, 325-331, 365-371, 391-398, 402-418, 422-428, 430-435, 443-452, 463-469, 476-484, 486-494, 503-509, 529-553, 560-565, 570-590, 608-614, 619-627, 654-661, 744-750, 772-780, 784-790, 806-816, 836-853, 876-885, 912-918, 926-933, 961-975, 980-987, 996-1006, 1016-1028, 1043-1053, 1057-1062, 994-1003 and 1033-1056 of Seq ID No 292; 17-45, 64-71, 73-81, 99-109, 186-192, 223-238, 262-275, 283-295, 336-346, 350-363, 375-385, 410-421, 425-431, 441-448, 454-463, 468-474, 476-512, 523-537, 539-552, 568-583, 599-608, 612-620, 628-641, 644-654, 656-662, 670-681, 685-695, 702-708, 716-723, 725-735, 757-764, 769-798, 800-806, 808-816, 826-840, 846-854, 856-862, 874-881, 885-902, 907-928, 274-350 and 443-513 of Seq ID No 293; 4-22, 29-41, 45-51, 53-61, 70-76, 85-92, 99-104, 111-122, 134-140, 142-154, 163-174, 224-232, 255-265, 273-279, 283-297, 330-335, 337-348, 356-367, 373-385, 391-396, 421-431, 442-455, 475-485, 493-505, 526-538, 544-561, 587-599, 605-620, 622-651, 662-670, 675-681, 687-692, 697-712, 714-735 and 252-262 of Seq ID No 294; 4-12, 15-35, 40-46, 50-59, 67-94, 110-128, 143-169, 182-188, 207-215, 218-228, 238-250 and 74-90 of Seq ID No 295; 9-18, 42-58, 78-85, 88-95, 97-106, 115-122, 128-134, 140-145, 154-181, 186-202, 204-223, 261-267, 269-278, 284-293, 300-336, 358-368 and 12-29 of Seq ID No 296; 7-34, 46-53, 62-72, 82-88, 100-105, 111-117, 132-137, 144-160, 166-180, 183-189, 209-221, 231-236, 246-253, 268-282, 286-293, 323-336, 364-372, 378-392, 422-433 and 388-405 of Seq ID No 297; 21-27, 34-50, 72-77, 80-95, 164-177, 192-198, 202-220, 226-236, 239-247, 270-279, 285-292, 315-320, 327-334, 348-355, 364-371, 388-397, 453-476, 488-497, 534-545, 556-576, 582-588, 601-607, 609-616, 642-662, 674-681, 687-697, 709-715, 721-727, 741-755 and 621-739 of Seq ID No 298; 4-14, 16-77, 79-109 and 25-99 of Seq ID No 299; 4-9, 17-23, 30-37, 44-55, 65-72, 77-93, 102-121, 123-132, 146-153 and 17-29 of Seq ID No 300; 4-18, 25-41, 52-60, 83-92, 104-112, 117-123, 149-155, 159-167, 170-192, 201-210, 220-227, 245-250 and 124-137 of Seq ID No 301; 8-25, 50-55, 89-95, 138-143, 148-153, 159-169, 173-179, 223-238, 262-268, 288-295, 297-308, 325-335, 403-409, 411-417, 432-446, 463-475, 492-501, 524-530, 542-548, 561-574, 576-593, 604-609, 612-622, 637-654, 665-672, 678-685, 720-725, 731-739, 762-767, 777-783, 820-838, 851-865, 901-908, 913-920, 958-970, 1000-1006, 1009-1015, 1020-1026, 1043-1052, 1055-1061, 1-128, 252-341, 771-793 and 1043-1058 of Seq ID No 302; 16-26, 33-46 and 64-76 of Seq ID No 303; 4-27, 69-77, 79-101, 117-123, 126-142, 155-161, 171-186, 200-206, 213-231, 233-244, 267-273, 313-329, 335-344, 347-370, 374-379, 399-408, 422-443, 445-453, 461-468, 476-482, 518-534, 544-553, 556-567, 578-595, 601-620, 626-636, 646-658, 666-681, 715-721, 762-768, 778-785, 789-803, 809-819, 22-108, 153-318, 391-527 and 638-757 of Seq ID No 304; 6-21, 32-43, 62-92, 104-123, 135-141, 145-152, 199-216, 218-226, 237-247, 260-269, 274-283, 297-303, 1-72 and 127-211 of Seq ID No 305; 6-26, 50-56, 83-89, 108-114, 123-131, 172-181, 194-200, 221-238, 241-247, 251-259, 263-271, 284-292, 304-319, 321-335, 353-358, 384-391, 408-417, 424-430, 442-448, 459-466, 487-500, 514-528, 541-556, 572-578, 595-601, 605-613, 620-631, 635-648, 660-670, 673-679, 686-693, 702-708, 716-725, 730-735, 749-755, 770-777, 805-811, 831-837, 843-851, 854-860, 863-869, 895-901, 904-914, 922-929, 933-938, 947-952, 956-963, 1000-1005, 1008-1014, 1021-1030, 1097-1103, 1120-1130, 1132-1140, 1-213, 269-592 and 992-1120 of Seq ID No 306; 9-16, 33-39, 47-59, 65-79, 81-95, 103-108, 115-123, 138-148, 163-171, 176-185, 191-196, 205-211, 213-221, 224-256, 261-276, 294-302, 357-363, 384-390, 95-111 and 161-189 of Seq ID No 307; 21-27, 35-45, 70-76, 92-105, 129-143, 145-155, 161-166, 170-191, 204-211, 214-231, 234-246, 249-255, 259-275 and 1-18 of Seq ID No 308; 21-35, 45-53, 56-64, 69-97 and 1-16 of Seq ID No 309; 25-33, 41-47, 61-68, 86-101, 106-114, 116-129, 134-142, 144-156, 163-176, 181-190, 228-251, 255-261, 276-292, 295-305, 334-357, 368-380, 395-410, 424-429, 454-460, 469-482, 510-516, 518-527, 531-546, 558-570, 579-606, 628-636, 638-645, 651-656, 668-674, 691-698, 717-734, 742-754, 765-770, 792-797, 827-835, 847-859, 874-881, 903-909, 926-933, 942-961, 964-977, 989-1004, 1010-1028, 1031-1047, 1057-1075, 1081-1095, 1108-1117, 1138-1144, 1182-1189, 1193-1206, 1220-1229, 1239-1246, 1257-1267, 1271-1279, 1284-1301, 1312-1320, 1329-1335, 1341-1347, 1358-1371, 1399-1404, 1417-1426, 1458-1463, 1468-1476, 1478-1485, 1493-1506, 1535-1541, 1559-1574, 1583-1590, 1595-1601, 1603-1611, 1622-1628, 1634-1644, 1671-1685, 1689-1696, 1715-1720, 1734-1746, 1766-1775, 1801-1806, 1838-1844, 1858-1871, 1910-1917, 1948-1955, 1960-1974, 2000-2015, 2019-2036, 2041-2063, 748-847 and 1381-1391 of Seq ID No 310; 5-12, 18-24, 27-53, 56-63, 96-113, 119-124, 131-136, 157-163, 203-209, 215-223, 233-246, 264-273, 311-316, 380-389, 393-399, 425-433, 445-450, 457-462, 464-470, 475-482, 507-513, 527-535, 542-548, 550-565, 591-602, 607-613, 627-642, 644-664, 673-712, 714-732, 739-764, 769-782, 812-818, 826-838, 848-854, 860-871, 892-906, 930-938, 940-954, 957-973, 990-998, 1002-1021, 1024-1033, 1037-1042, 1050-1060, 1077-1083, 1085-1092, 1100-1129, 1144-1161, 1169-1175, 1178-1189, 1192-1198, 1201-1207, 1211-1221, 1229-1239, 1250-1270, 1278-1292, 1294-1300, 1314-1335, 1344-1352, 1360-1374, 1394-1405, 1407-1414, 1416-1424, 1432-1452, 1456-1462, 1474-1497, 1500-1510, 1516-1522, 1534-1542, 1550-1559, 1584-1603, 1608-1627, 187-273 and 306-441 of Seq ID No 311; 70-80, 90-97, 118-125, 128-140, 142-148, 154-162, 189-202, 214-222, 224-232, 254-260, 275-313, 317-332, 355-360, 392-398, 425-432, 448-456, 464-470, 476-482, 491-505, 521-528, 533-546, 560-567, 592-597, 605-614, 618-626, 637-644, 646-653, 660-666, 677-691 and 207-227 of Seq ID No 312; 5-19, 26-34, 37-55, 57-66, 69-83, 86-102, 115-134, 138-143, 154-172, 178-195, 209-246, 251-257, 290-302, 306-311 and 256-266 of Seq ID No 313; 10-20, 22-28, 35-57, 72-79, 87-103, 108-128, 130-144, 158-171, 190-198, 225-242, 274-291, 301-315, 317-324, 374-385 and 353-365 of Seq ID No 314; 4-9, 17-30, 34-54, 59-66, 73-94, 118-130, 135-150, 158-171, 189-198, 219-239, 269-275, 283-301, 89-106 and 176-193 of Seq ID No 315; 14-20, 22-74, 77-86, 89-99, 104-109, 126-135, 154-165, 181-195, 197-212, 216-224, 264-275 and 107-118 of Seq ID No 316; 4-18, 21-38, 63-72, 101-109, 156-162, 165-179, 183-192, 195-210, 212-218, 230-239, 241-256, 278-290, 299-311, 313-322, 332-341, 348-366, 386-401, 420-426, 435-450, 455-460, 468-479, 491-498, 510-518, 532-538, 545-552, 557-563, 567-573, 586-595, 599-609, 620-626, 628-636, 652-657, 665-681 and 1-198 of Seq ID No 317; 4-10, 16-38, 51-68, 73-79, 94-115, 120-125, 132-178, 201-208, 216-223, 238-266, 269-295, 297-304, 337-342, 347-356, 374-401, 403-422, 440-447, 478-504, 510-516, 519-530, 537-544 and 191-206 of Seq ID No 318; 12-40, 42-48, 66-71, 77-86, 95-102, 113-120, 129-137, 141-148, 155-174, 208-214, 218-225, 234-240, 256-267, 275-283, 300-306, 313-321, 343-350, 359-367, 370-383, 398-405, 432-439, 443-461, 492-508, 516-526, 528-535 and 370-478 of Seq ID No 319; 6-14, 20-37, 56-62, 90-95, 97-113, 118-125, 140-145, 161-170, 183-202, 237-244, 275-284, 286-305, 309-316, 333-359, 373-401, 405-412 and 176-187 of Seq ID No 320; 33-44, 50-55, 59-80, 86-101, 129-139, 147-153, 157-163, 171-176, 189-201, 203-224, 239-245, 257-262, 281-287, 290-297, 304-320, 322-331, 334-350, 372-390, 396-401, 71-88 and 353-372 of Seq ID No 321; 5-11, 15-24, 26-33, 40-47, 75-88, 95-103, 105-112 and 17-30 of Seq ID No 322; 5-11, 16-39, 46-54, 62-82, 100-107, 111-124, 126-150, 154-165, 167-183, 204-238, 245-295, 301-313, 316-335 and 8-16 of Seq ID No 323; 4-19, 34-48, 69-74, 79-107, 115-127, 129-135, 143-153, 160-169, 171-182 and 142-153 of Seq ID No 324; 4-30, 65-74, 82-106, 110-120, 124-132, 135-140, 146-175, 179-184, 190-196, 217-223, 228-233, 250-267, 275-292, 303-315, 322-332 and 174-186 of Seq ID No 325; 9-16, 29-41, 47-57, 68-84, 87-109, 113-119, 162-180, 186-193, 195-201, 203-208, 218-230, 234-243, 265-271, 281-292, 305-312, 323-332, 341-347, 349-363, 368-374, 383-390, 396-410, 434-440, 446-452, 455-464, 466-473, 515-522, 529-542, 565-570, 589-600, 602-613, 618-623, 637-644, 1019-1027, 1238-1244, 1258-1264, 1268-1276, 1281-1292, 1296-1302 and 883-936 of Seq ID No 326; 10-17, 23-32, 39-44, 54-72, 75-81, 88-111, 138-154, 160-167, 178-185, 201-210, 236-252, 327-334, 336-342, 366-376, 388-400, 410-430, 472-482, 493-526, 552-558, 586-592, 598-603, 612-621, 630-635, 641-660 and 384-393 of Seq ID No 327; 4-22, 24-39, 50-59, 73-84, 100-105, 111-117, 130-138, 155-161, 173-178, 182-189, 205-215, 266-284, 308-313, 321-328, 330-337, 346-363, 368-374, 388-395, 397-405, 426-434, 453-459, 482-492, 501-507, 509-515, 518-523, 527-544, 559-590, 598-612, 614-629, 646-659, 663-684, 686-694, 698-721 and 445-461 of Seq ID No 328; 14-22, 27-33 and 3-17 of Seq ID No 329; 29-41, 66-73, 81-87, 90-108, 140-146, 150-159, 165-184, 186-196, 216-226, 230-238, 247-253, 261-269 and 126-140 of Seq ID No 330; 5-12, 16-25, 27-33, 36-45, 60-68, 83-88, 103-126 and 86-101 of Seq ID No 331; 14-23, 36-47, 56-66, 84-89, 94-105, 111-127, 140-153, 160-174, 176-183, 189-203, 219-225, 231-237, 250-257 and 194-227 of Seq ID No 332; 4-25, 54-60, 64-71, 73-82, 89-106, 117-124, 157-169, 183-188, 199-210, 221-232, 236-244, 255-264 and 58-98 of Seq ID No 333; 13-19, 26-36, 41-53, 55-71, 77-84, 86-108, 114-135, 157-172, 177-183, 187-194, 208-213, 218-226, 110-125 and 156-170 of Seq ID No 334; 5-24, 63-69, 77-85, 94-112, 120-137, 140-146, 152-159, 166-172, 179-187, 193-199, 206-212, 222-228, 234-240, 244-252, 257-264, 270-289, 298-309, 316-328, 337-348, 363-375, 1-56 and 340-352 of Seq ID No 335; 18-39, 42-71, 78-120, 124-144, 152-173, 179-189, 199-209, 213-222, 228-258, 269-304, 329-361, 364-372, 374-389, 396-441 and 313-327 of Seq ID No 336; 19-25, 91-98, 108-120, 156-162, 168-174, 191-204, 211-216, 232-266, 272-278, 286-308, 316-321, 327-333, 344-355, 358-364, 384-391, 395-428, 464-476, 487-495, 497-511, 544-561, 563-573, 575-582, 588-594, 10-25 and 322-338 of Seq ID No 337; 14-26, 32-49, 51-57, 59-72, 80-91, 102-112, 119-125, 147-161, 164-173, 175-183, 188-213, 217-222, 246-254, 260-276, 282-303, 308-318, 321-328, 333-350, 352-359, 371-378, 392-401, 407-414, 416-443, 448-463, 471-484, 490-497, 501-514, 519-527, 539-551, 557-570, 578-590, 592-598, 600-610, 618-629, 633-647, 654-667, 676-689, 702-709, 718-726, 728-737, 741-760, 764-780, 786-795, 808-826, 836-842, 845-852, 865-874, 881-887, 931-945, 949-957, 968-974, 979-986, 1003-1009, 1023-1029 and 90-103 of Seq ID No 338; 11-16, 37-56, 60-66, 69-77, 80-88, 93-106, 117-139, 166-171 and 72-90 of Seq ID No 339; 59-84, 123-133, 145-150, 161-167, 178-189 and 115-128 of Seq ID No 340; 15-33, 39-46, 52-64, 74-87, 108-124, 127-144, 150-156, 173-179, 184-194, 201-208, 219-236, 243-269, 272-295, 302-309, 343-349, 356-361, 370-379, 405-411, 414-423, 430-451, 457-464, 466-475, 477-483, 496-502, 507-522, 541-548, 557-563, 571-577, 579-585, 590-605, 626-642, 650-662, 671-691, 704-710, 751-769, 775-781, 786-791, 794-829, 851-858, 868-878, 884-904, 913-919, 931-939 and 132-142 of Seq ID No 341; 33-58, 64-71, 74-80, 83-88, 96-120, 122-139, 146-157, 167-177, 207-213, 220-225, 236-242, 264-279, 300-305, 326-336, 340-347, 350-360, 97-115 and 199-211 of Seq ID No 342; 4-26, 43-57, 70-99, 102-117, 121-133, 142-148, 151-168, 170-183, 192-220, 235-249, 258-279 and 30-41 of Seq ID No 343; 34-42, 48-58, 70-94, 110-130, 154-160, 164-172, 178-183, 195-203, 211-222, 229-250, 256-261, 274-284, 286-292, 312-323 and 222-233 of Seq ID No 344; 4-9, 15-36, 38-45, 49-74, 78-88, 100-112, 136-191, 211-220, 226-233, 239-246, 254-274, 287-307, 316-322, 342-353, 356-366, 373-378, 384-393, 405-431, 449-457, 459-468, 487-511, 515-524, 529-541, 544-552, 562-568, 571-576 and 208-280 of Seq ID No 345; 10-27, 31-37, 39-54, 71-108, 124-143 and 2-107 of Seq ID No 346; 16-27, 38-57, 64-70, 90-102, 104-113, 116-137, 160-166 and 1-80 of Seq ID No 347; 13-21, 31-36, 56-67, 127-136, 153-171, 173-180, 184-200, 214-222, 225-231, 239-263, 267-273 and 135-159 of Seq ID No 348; 12-27, 31-51, 68-74, 77-87, 94-101, 108-114, 117-123, 127-134, 138-168, 173-196, 201-207, 212-217, 227-237, 247-257, 264-280 and 205-223 of Seq ID No 349; 17-22, 25-54, 70-76, 92-100 and 98-110 of Seq ID No 350; 7-29, 40-50, 60-67, 87-96, 105-111, 119-164, 172-199, 206-212, 220-227, 237-259, 272-279, 282-293, 295-309, 313-319, 321-328, 345-363, 376-386 and 159-176 of Seq ID No 351; 4-19, 24-30, 36-43, 50-68, 71-89, 93-106, 141-152, 154-172, 179-197, 199-215, 229-239, 246-252, 255-263, 281-298, 319-325, 329-356, 358-368, 374-390, 397-409, 420-429, 432-444, 450-456, 459-475, 483-494, 496-502, 520-528, 532-556 and 362-377 of Seq ID No 352; 18-25, 40-62, 77-85, 91-97, 105-116, 123-133, 139-184, 189-197 and 122-140 of Seq ID No 353; 4-49, 52-58, 62-70, 79-105, 109-133, 142-150, 163-168, 206-214, 220-228, 233-240, 243-254, 274-281, 303-311, 327-338, 357-373, 378-396, 403-413, 420-436, 441-453, 461-467, 475-481, 484-498, 506-512, 514-521, 523-529, 562-579, 589-595, 598-603, 615-648, 714-722, 728-742, 749-758, 777-792, 795-807 and 643-658 of Seq ID No 354; 8-27, 37-48, 51-56, 72-79, 87-106, 120-138, 140-147, 167-176, 187-197, 205-216, 222-229, 234-239, 243-249, 277-288, 292-315, 334-343, 347-353, 363-391, 398-404, 430-447, 461-467, 478-492, 498-507 and 456-470 of Seq ID No 355; 5-12, 18-24, 59-69, 80-93, 95-109, 119-125, 130-137, 139-147, 158-163, 168-176, 182-202, 206-215, 222-239, 241-249, 267-277, 291-298, 311-318, 321-327, 338-344, 348-355, 373-386, 393-406, 411-417, 434-443, 446-465, 473-484, 514-521, 532-553, 584-594 and 221-237 of Seq ID No 356; 4-14, 27-34, 50-58, 63-72, 79-106, 109-114, 121-142, 146-154, 161-167, 169-175, 178-201, 223-238, 249-254, 259-264, 278-292, 294-312, 319-330 and 167-191 of Seq ID No 357; 7-28, 36-42, 50-61, 63-80, 122-152, 161-174, 176-191 and 140-190 of Seq ID No 358; 20-57, 59-65, 70-78, 86-102, 119-133, 142-161, 163-173, 177-188, 192-202, 204-220, 222-236, 240-253, 279-319, 326-331, 337-383, 390-399, 406-412, 420-427, 431-438 and 381-395 of Seq ID No 359; 13-18, 28-34, 37-43, 50-59, 75-81, 83-97, 105-121, 139-147, 200-206, 209-227, 231-247, 260-271, 318-327, 366-381, 388-394, 399-406 and 182-201 of Seq ID No 360; 6-29, 37-43, 51-56, 70-77, 82-102, 110-119, 127-143, 178-190, 201-209, 216-243, 261-269, 281-292, 305-313, 327-339, 341-354, 356-373, 391-397, 423-429, 438-445, 450-478 and 21-314 of Seq ID No 361; 4-12, 15-21, 32-41, 59-76, 80-89, 96-104 and 90-103 of Seq ID No 362; 9-28, 30-41, 44-54, 69-74, 77-82, 90-97, 104-123, 125-135, 149-155, 164-173, 177-184, 217-226, 230-235, 238-244, 258-272, 282-297, 300-305, 309-315, 317-322, 327-336, 348-362, 368-374, 380-387, 400-411, 414-424, 451-458, 460-466, 483-494, 497-503, 506-511, 521-528, 540-553, 569-587, 598-606, 628-642, 661-681, 688-700, 718-733, 740-749, 752-764, 769-783, 823-834, 848-854, 862-872, 878-884, 886-898, 915-920, 938-951, 954-961, 963-972, 982-989, 996-1003, 1010-1016, 1021-1032, 1038-1044, 1047-1057, 1060-1070, 1079-1088, 1094-1102, 1117-1127, 1129-1135, 1142-1153, 1158-1204, 1212-1229, 1234-1263, 1269-1277, 1308-1313, 1327-1338, 1344-1376, 1400-1415, 1436-1443, 1448-1458, 1497-1504, 1511-1522, 1544-1566, 3-82 and 509-576 of Seq ID No 363; 8-36, 40-64, 71-79, 88-94, 102-109, 118-127, 138-148, 151-159, 163-174, 192-198, 200-206, 220-233, 268-273, 290-301, 304-309, 316-323, 331-349, 378-391, 414-420, 427-437, 455-475, 494-510, 541-547, 549-555, 616-640, 1-60, 55-139, 212-308, 386-458 and 458-624 of Seq ID No 364; 16-31, 35-42, 70-77, 91-101, 120-130, 132-140, 143-153, 185-190, 195-202, 215-222, 228-238, 241-251, 257-264, 268-277, 288-302, 312-324, 326-333, 341-348, 364-382, 415-429, 438-454, 458-466, 491-499, 501-521 and 273-281 of Seq ID No 365; 8-14, 32-57, 74-149, 155-177, 179-212, 221-266, 271-296, 304-324, 329-346, 349-359, 368-401, 413-419, 426-454, 465-478, 493-510 and 466-490 of Seq ID No 366; 22-28, 33-51, 64-89, 96-119, 126-132, 138-146, 152-159, 161-169, 172-179, 193-198, 205-211, 221-231, 235-254, 273-280, 297-303, 312-320, 328-346, 351-373, 378-384, 391-398, 448-454, 460-468, 470-481, 516-558, 574-593, 597-602, 613-623, 626-646, 649-656, 668-673, 675-683, 696-708, 715-722, 724-739, 745-751, 759-777, 780-804, 816-822 and 102-113 of Seq ID No 367; 12-28, 41-91, 98-107, 112-120, 125-131, 151-193, 215-221, 240-250, 263-280 and 128-138 of Seq ID No 368; 16-24, 32-38, 46-62, 68-81, 90-105, 127-133, 144-150, 160-166, 178-184, 186-202, 210-219, 232-240, 252-258, 264-273, 293-324, 337-344, 349-357, 360-369, 385-398, 410-416, 419-427, 441-449, 458-476, 508-515, 523-539, 544-549, 562-569, 571-579, 96-109 and 127-139 of Seq ID No 369; 19-25, 28-34, 56-61, 85-97, 110-116 and 39-53 of Seq ID No 370; 4-37, 41-50, 62-72, 91-97, 99-109, 114-125, 136-141, 149-158, 160-166, 201-215 and 27-225 of Seq ID No 371; 15-31, 44-51, 96-105, 122-130, 149-157, 162-168, 178-183, 185-192, 198-204, 206-213, 221-234, 239-245, 248-255, 257-266, 289-335, 349-357, 415-422, 425-441, 448-454, 462-468 and 463-481 of Seq ID No 372; 5-31, 39-55, 63-72, 76-99, 106-155, 160-177, 179-199, 207-217, 223-240, 245-255, 261-267, 294-316, 321-343, 354-378, 382-452, 477-488, 529-536, 555-569, 584-591, 593-612, 620-627, 632-640, 647-654, 671-680, 698-704, 723-730, 732-750, 769-775, 781-788, 822-852 and 505-525 of Seq ID No 373; 3-18 of Seq ID No 374; 4-14 and 12-24 of Seq ID No 375; 4-11, 22-30 and 12-25 of Seq ID No 376; 5-12 and 4-18 of Seq ID No 377; 4-28 and 7-14 of Seq ID No 378; 6-16 and 8-16 of Seq ID No 379; 4-15, 18-33 and 24-36 of Seq ID No 380; 4-10, 16-21 and 20-31 of Seq ID No 381; 6-19 of Seq ID No 382; 11-18 and 3-10 of Seq ID No 383; 13-24 and 3-15 of Seq ID No 384; 15-27 and 7-16 of Seq ID No 385; 11-16 and 1-15 of Seq ID No 386; 4-16 and 9-21 of Seq ID No 387; 4-24, 40-48, 54-67 and 22-39 of Seq ID No 388; 6-30, 34-55, 62-68, 78-106 and 68-74 of Seq ID No 389; 3-14 of Seq ID No 390; 9-19 and 6-21 of Seq ID No 391; 4-17 and 1-9 of Seq ID No 392; 5-30 and 1-8 of Seq ID No 393; 4-16, 23-46, 51-56 and 45-55 of Seq ID No 394; 7-16 of Seq ID No 395; 2-14 of Seq ID No 396; 4-36, 43-65 and 50-62 of Seq ID No 397; 10-30 and 14-21 of Seq ID No 398; 9-17 and 1-10 of Seq ID No 399; 4-12 and 3-16 of Seq ID No 400; 4-15 and 5-23 of Seq ID No 401; 10-21 of Seq ID No 402; 6-16 of Seq ID No 403; 4-29, 31-38 and 2-14 of Seq ID No 404; 4-35 and 33-42 of Seq ID No 405; 2-17 of Seq ID No 406; 9-18, 30-35 and 15-33 of Seq ID No 407; 4-9 and 6-12 of Seq ID No 408; 3-17 of Seq ID No 409; 12-21, 37-44, 52-61, 72-80 and 38-48 of Seq ID No 410; 4-10, 29-44, 54-61, 69-78 and 13-27 of Seq ID No 411; 13-23, 36-53 and 2-15 of Seq ID No 412; 4-25, 28-46, 56-72, 81-99, 120-132, 134-142, 154-160 and 129-141 of Seq ID No 413; 4-15, 24-33, 35-41, 64-86 and 21-33 of Seq ID No 414; 9-15 and 4-13 of Seq ID No 415; 4-11, 13-19, 34-48 and 15-32 of Seq ID No 416; 4-21 and 11-31 of Seq ID No 417; 23-57 and 38-50 of Seq ID No 418; 4-32 and 3-13 of Seq ID No 419; 4-10, 13-25, 32-42, 56-68, 72-84 and 26-38 of Seq ID No 420; 4-20, 31-48, 52-58, 65-71, 80-93, 99-108, 114-123 and 37-49 of Seq ID No 421; 6-12, 14-20 and 3-25 of Seq ID No 422; 14-25, 27-38 and 5-14 of Seq ID No 423; 4-41, 57-105, 109-118, 123-136, 144-152 and 86-99 of Seq ID No 424; 6-19 of Seq ID No 425; 2-19 of Seq ID No 426; 14-47 and 1-14 of Seq ID No 427; 4-21, 29-44 and 2-18 of Seq ID No 428; 23-29 and 10-28 of Seq ID No 429; 6-16, 22-36 and 11-22 of Seq ID No 430; 4-19, 30-44 and 18-27 of Seq ID No 431; 5-15, 37-45, 58-65 and 38-47 of Seq ID No 432; 4-15, 23-34 and 4-15 of Seq ID No 433; 30-36, 44-54, 79-85, 101-114, 138-152, 154-164, 170-175, 179-200, 213-220, 223-240, 243-255, 258-264, 268-284 and 10-28 of Seq ID No 434; the peptides comprising amino acid sequences of column "Identical region" of the Table 1B, especially peptides comprising amino acid 210-226 and 738-753 of Seq ID No 449; 326-344, 326-348, 338-354, 371-392, 801-809 and 877-901 of Seq ID No 450; 893-906 of Seq ID No 451; 51-69 of Seq ID No 452; 110-125 of Seq ID No 453; 291-305 of Seq ID No 454; 210-226 and 738-753 of Seq ID No 455; 326-344, 326-348, 338-354, 371-392, 801-809 and 877-901 of Seq ID No 456; 893-906 of Seq ID No 457; 51-69 of Seq ID No 458; 110-125 of Seq ID No 459; 291-305 of Seq ID No 460; 32-44 of Seq ID No 461; 399-410 of Seq ID No 462; the serum reactive epitopes as specified in the column of "aa from" to "aa to" of Table 2, especially peptides comprising amino acid 120-143, 138-161 and 156-179 of Seq ID No 218; 110-129 and 168-184 of Seq ID No 219; 74-90 of Seq ID No 222; 759-773 of Seq ID No 223; 237-260 of Seq ID No 224; 265-284 of Seq ID No 225; 65-74 of Seq ID No 226; 41-50 of Seq ID No 227; 163-174 of Seq ID No 229; 26-37 of Seq ID No 230; 174-189 of Seq ID No 232; 240-256 of Seq ID No 234; 285-297 of Seq ID No 236; 238-247 of Seq ID No 238; 491-519 of Seq ID No 239; 114-140 of Seq ID No 243; 267-284 of Seq ID No 250; 439-453 of Seq ID No 252; 162-178 of Seq ID No 253; 347-364 of Seq ID No 254; 699-715 of Seq ID No 255; 60-71 of Seq ID No 256; 244-257 of Seq ID No 257; 44-63 and 57-76 of Seq ID No 258; 185-196 of Seq ID No 260; 119-129 of Seq ID No 263; 182-195 of Seq ID No 266; 32-44 and 424-442 of Seq ID No 267; 247-256 of Seq ID No 268; 678-694, 785-805, 55-77 and 72-94 of Seq ID No 269; 210-226 of Seq ID No 281; 37-59 of Seq ID No 289; 13-29 of Seq ID No 296; 136-159 of Seq ID No 348; 205-222 of Seq ID No 349; 99-110 of Seq ID No 350; 160-176 of Seq ID No 351; 457-470 of Seq ID No 355; 221-237 of Seq ID No 356; 167-190 of Seq ID No 357; 96-120 of Seq ID No 361; 399-417, 503-519 and 544-563 of Seq ID No 364; 46-68, 159-183 and 184-198 of Seq ID No 371; 463-481 of Seq ID No 372; the immunogenic epitopes as specified in the column of "aa from" to "aa to" of Table 4; especially peptides comprising amino acid 110-129 and 168-184 of Seq ID No 219; 877-901, 333-354, 326-344 and 801-809 of Seq ID No 277; 1-54 of Seq ID No 347; 544-563, 31-51, 107-119, 399-417 and 503-519 of Seq ID No 364; 120-198 of Seq ID No 218; 20-35 of Seq ID No 219; 118-201 of Seq ID No 221; 48-132 of Seq ID No 242; 118-136 of Seq ID No 249; 162-178 of Seq ID No 253; 347-364 of Seq ID No 254; 699-715 of Seq ID No 255; 50-76 of Seq ID No 258; 785-819 and 44-128 of Seq ID No 269; 90-128 of Seq ID No 274; 314-384 of Seq ID No 289; 327-349 of Seq ID No 293; 242-314, 405-478 and 23-100 of Seq ID No 304; 129-210 of Seq ID No 305; 162-188 of Seq ID No 307; 750-772 of Seq ID No 310; 1-56 of Seq ID No 335; 322-337 of Seq ID No 337; 72-90 of Seq ID No 339; 374-395 of Seq ID No 345; 136-159 of Seq ID No 348; 141-164 of Seq ID No 358; 96-157 of Seq ID No 361; 1-82 of Seq ID No 363; 489-556 of Seq ID No 364; 159-183 and 49-133 of Seq ID No 371; The peptides comprising amino acid sequences of column "predicted immunogenic aa" and "location of identified immunogenic region (aa)" of Table 5, especially peptides comprising amino acid 4-26, 35-41, 53-61, 73-84, 103-108, 114-120, 140-146, 156-162, 192-208, 214-219, 227-233, 239-252, 260-268, 284-297, 1-48 and 113-133 of Seq ID No 475; 4-27, 38-44, 50-56, 59-64, 72-79, 83-89, 92-97, 108-116, 123-148, 152-167, 183-196, 200-220, 232-244, 255-261, 265-274, 282-302, 309-317, 1-79 and 231-302 of Seq ID No 476; 6-28, 66-72, 85-105, 115-121, 144-151, 160-170, 176-185, 223-230, 252-288, 296-310, 319-333, 367-374, 458-464, 471-480, 483-488, 520-528, 530-549, 559-564, 593-601, 606-616, 636-643, 655-662, 676-682, 684-699, 719-726, 735-750, 757-764, 777-785, 799-810, 812-843, 846-853, 868-873, 880-889, 891-899, 909-929, 934-940, 963-969, 998-1004, 1007-1014, 1016-1022, 1030-1046, 1-80 and 808-821 of Seq ID No 477; 7-24, 35-41, 75-81, 91-114, 122-132, 137-144, 148-156, 183-192, 194-200, 212-228, 233-238, 251-258, 275-295, 326-332, 337-346, 1-79 and 305-321 of Seq ID No 478; 31-38, 42-52, 66-72, 86-92, 98-104, 115-122, 127-146, 154-164, 169-187, 198-212, 225-237, 255-269, 13-92 and 135-142 of Seq ID No 479; 4-36, 39-49, 63-69, 71-77, 81-88, 123-131, 133-139, 160-169, 174-180, 188-194, 210-217, 273-278, 289-300, 317-334, 336-341, 383-401, 425-438, 1-68, 212-270 and 402-446 of Seq ID No 480; 21-29, 31-42, 49-63, 72-79, 81-93, 112-132, 159-165, 188-195, 197-232, 262-267, 279-286, 294-301, 318-326, 348-366, 381-405, 409-426, 436-465, 471-480, 484-492, 497-505, 521-544, 554-561, 567-577, 581-589, 601-609, 611-622, 636-651, 653-667, 669-685, 700-708, 716-722, 729-744, 749-766, 780-786, 789-811, 814-864, 1-57 and 84-106 of Seq ID No 481; 6-24, 35-48, 57-63, 72-78, 87-92, 113-119, 123-137, 147-153, 173-181, 212-233 and 1-124 of Seq ID No 482; 13-34, 62-69, 78-83, 86-91, 98-104, 107-115, 146-159, 179-188, 195-205, 209-221, 226-233, 239-253, 276-282, 284-294, 297-308, 331-354, 375-382, 388-399, 421-433, 449-458, 464-469, 472-491, 508-513, 525-531, 534-550, 575-593, 601-618, 629-635, 654-661, 666-680, 706-721, 723-740, 771-805, 810-830, 845-851 and 1-84 of Seq ID No 483; 4-32, 45-64, 73-83, 86-92, 100-111, 125-147, 157-163, 170-175, 177-188, 226-232, 245-252, 258-274, 320-335, 348-359 and 1-71 of Seq ID No 484; 13-40, 43-71, 76-83, 87-101, 109-119, 125-156, 162-175, 182-219, 226-232, 240-262, 270-287, 306-318, 326-342, 344-408, 414-444, 449-456 and 1-51 of Seq ID No 485; 4-16, 18-34, 45-54, 99-108, 134-140, 203-212, 241-257, 266-274, 279-291, 308-315, 330-336, 355-370, 374-382, 402-410, 428-455, 466-472, 474-480, 531-554, 560-566, 572-580, 597-618, 632-660, 664-674, 676-685, 691-705, 708-735, 750-768, 1-87 and 342-480 of Seq ID No 486; The serum reactive epitopes as specified in the column of "aa from" to "aa to" of Table 6, especially peptides comprising amino acid 115-132 and 1-26 of Seq ID No 475; 33-55 of Seq ID No 476; 1-25 of Seq ID No 478; 37-61 of Seq ID No 479; 1-24 of Seq ID No 480; 1-23 of Seq ID No 481; 46-60 of Seq ID No 482; 1-28, 23-50 and 45-71 of Seq ID No 483; 1-22 and 17-38 of Seq ID No 484; 1-22 and 17-38 of Seq ID No 485; 1-27, 22-47 and 422-447 of Seq ID No 486; The immunogenic epitopes as specified in the column of "aa from" to "aa to" of Table 7, especially peptides comprising amino acid 115-132 and 1-47 of Seq ID No 475; 1-55 of Seq ID No 476; 22-85 of Seq ID No 477; 307-320 and 1-44 of Seq ID No 478; 15-76 and 40-92 of Seq ID No 479; 1-59, 213-269 and 403-445 of Seq ID No 480; 1-56 and 85-105 of Seq ID No 481; 37-121 of Seq ID No 482; 1-71 of Seq ID No 483; 1-38 of Seq ID No 484; 1-38 of Seq ID No 485; 1-47 of Seq ID No 486 and fragments comprising at least 6, preferably more than 8, especially more than 10 aa and preferably not more than 70, 50, 40, 20, 15 or 11 aa of said sequences. All these fragments individually and each independently form a preferred selected aspect of the present invention.

All linear hyperimmune serum reactive fragments of a particular antigen may be identified by analysing the entire sequence of the protein antigen by a set of peptides overlapping by 1 amino acid with a length of at least 10 amino acids. Subsequently, non-linear epitopes can be identified by analysis of the protein antigen with hyperimmune sera using the expressed full-length protein or domain polypeptides thereof. Assuming that a distinct domain of a protein is sufficient to form the 3D structure independent from the native protein, the analysis of the respective recombinant or synthetically produced domain polypeptide with hyperimmune serum would allow the identification of conformational epitopes within the individual domains of multi-domain proteins. For those antigens where a domain possesses linear as well as conformational epitopes, competition experiments with peptides corresponding to the linear epitopes may be used to confirm the presence of conformational epitopes.

It will be appreciated that the invention also relates to, among others, nucleic acid molecules encoding the aforementioned fragments, nucleic acid molecules that hybridize to nucleic acid molecules encoding the fragments, particularly those that hybridize under stringent conditions, and nucleic acid molecules, such as PCR primers, for amplifying nucleic acid molecules that encode the fragments. In these regards, preferred nucleic acid molecules are those that correspond to the preferred fragments, as discussed above.

The present invention also relates to vectors, which comprise a nucleic acid molecule or nucleic acid molecules of the present invention, host cells which are genetically engineered with vectors of the invention and the production of hyperimmune serum reactive antigens and fragments thereof by recombinant techniques.

A great variety of expression vectors can be used to express a hyperimmune serum reactive antigen or fragment thereof according to the present invention. Generally, any vector suitable to maintain, propagate or express nucleic acids to express a polypeptide in a host may be used for expression in this regard. In accordance with this aspect of the invention the vector may be, for example, a plasmid vector, a single or double-stranded phage vector, a single or double-stranded RNA or DNA viral vector. Starting plasmids disclosed herein are either commercially available, publicly available, or can be constructed from available plasmids by routine application of well-known, published procedures. Preferred among vectors, in certain respects, are those for expression of nucleic acid molecules and hyperimmune serum reactive antigens or fragments thereof of the present invention. Nucleic acid constructs in host cells can be used in a conventional manner to produce the gene product encoded by the recombinant sequence. Alternatively, the hyperimmune serum reactive antigens and fragments thereof of the invention can be synthetically produced by conventional peptide synthesizers. Mature proteins can be expressed in mammalian cells, yeast, bacteria, or other cells under the control of appropriate promoters. Cell-free translation systems can also be employed to produce such proteins using RNAs derived from the DNA construct of the present invention.

Host cells can be genetically engineered to incorporate nucleic acid molecules and express nucleic acid molecules of the present invention. Representative examples of appropriate hosts include bacterial cells, such as streptococci, staphylococci, *E. coli, Streptomyces* and *Bacillus subtillis* cells; fungal cells, such as yeast cells and *Aspergillus* cells; insect cells such as Drosophila S2 and Spodoptera Sf9 cells; animal cells such as CHO, COS, Hela, C127, 3T3, BHK, 293 and Bowes melanoma cells; and plant cells.

The invention also provides a process for producing a *S. agalactiae* hyperimmune serum reactive antigen and a fragment thereof comprising expressing from the host cell a hyperimmune serum reactive antigen or fragment thereof encoded by the nucleic acid molecules provided by the present invention. The invention further provides a process for producing a cell, which expresses a *S. agalactiae* hyperimmune serum reactive antigen or a fragment thereof comprising transforming or transfecting a suitable host cell with the vector according to the present invention such that the transformed or transfected cell expresses the polypeptide encoded by the nucleic acid contained in the vector.

The polypeptide may be expressed in a modified form, such as a fusion protein, and may include not only secretion signals but also additional heterologous functional regions. Thus, for instance, a region of additional amino acids, particularly charged amino acids, may be added to the N- or C-terminus of the polypeptide to improve stability and persistence in the host cell, during purification or during subsequent handling and storage. Also, regions may be added to the polypeptide to facilitate purification. Such regions may be removed prior to final preparation of the polypeptide. The addition of peptide moieties to polypeptides to engender secretion or excretion, to improve stability or to facilitate purification, among others, are familiar and routine techniques in the art. A preferred fusion protein comprises a heterologous region from immunoglobulin that is useful to solubilize or purify polypeptides. For example, EP-A-O 464 533 (Canadian counterpart 2045869) discloses fusion proteins comprising various portions of constant region of immunoglobin molecules together with another protein or part thereof. In drug discovery, for example, proteins have been fused with antibody Fc portions for the purpose of high-throughput screening assays to identify antagonists. See for example, {Bennett, D. et al., 1995} and {Johanson, K. et al., 1995}.

The *S. agalactiae* hyperimmune serum reactive antigen or a fragment thereof can be recovered and purified from recombinant cell cultures by well-known methods including ammonium sulfate or ethanol precipitation, acid extraction, anion or cation exchange chromatography, phosphocellulose chromatography, hydrophobic interaction chromatography, hydroxylapatite chromatography and lectin chromatography.

The hyperimmune serum reactive antigens and fragments thereof according to the present invention can be produced by chemical synthesis as well as by biotechnological means. The latter comprise the transfection or transformation of a host cell with a vector containing a nucleic acid according to the present invention and the cultivation of the transfected or transformed host cell under conditions, which are known to the ones skilled in the art. The production method may also comprise a purification step in order to purify or isolate the polypeptide to be manufactured. In a preferred embodiment the vector is a vector according to the present invention.

The hyperimmune serum reactive antigens and fragments thereof according to the present invention may be used for the detection of the organism or organisms in a sample containing these organisms or polypeptides derived thereof. Preferably such detection is for diagnosis, more preferable for the diagnosis of a disease, most preferably for the diagnosis of a diseases related or linked to the presence or abundance of Gram-positive bacteria, especially bacteria selected from the group comprising streptococci, staphylococci and lactococci. More preferably, the microorganisms are selected from the group comprising *Streptococcus pneumoniae, Streptococcus pyogenes* and *Streptococcus mutans*, especially the microorganism is *Streptococcus pyogenes*.

The present invention also relates to diagnostic assays such as quantitative and diagnostic assays for detecting levels of the hyperimmune serum reactive antigens and fragments thereof of the present invention in cells and tissues, including determination of normal and abnormal levels. Thus, for instance, a diagnostic assay in accordance with the invention for detecting over-expression of the polypeptide compared to normal control tissue samples may be used to detect the presence of an infection, for example, and to identify the infecting organism. Assay techniques that can be used to determine levels of a polypeptide, in a sample derived from a host are well known to those of skill in the art. Such assay methods include radioimmunoassays, competitive-binding assays, Western Blot analysis and ELISA assays. Among these, ELISAs frequently are preferred. An ELISA assay initially comprises preparing an antibody specific to the polypeptide, preferably a monoclonal antibody. In addition, a reporter antibody generally is prepared which binds to the monoclonal antibody. The reporter antibody is attached to a detectable reagent such as radioactive, fluorescent or enzymatic reagent, such as horseradish peroxidase enzyme.

The hyperimmune serum reactive antigens and fragments thereof according to the present invention may also be used for the purpose of or in connection with an array. More particularly, at least one of the hyperimmune serum reactive antigens and fragments thereof according to the present invention may be immobilized on a support. Said support typically comprises a variety of hyperimmune serum reactive antigens and fragments thereof whereby the variety may be created by using one or several of the hyperimmune serum reactive antigens and fragments thereof according to the present invention and/or hyperimmune serum reactive antigens and fragments thereof being different. The characterizing feature of such array as well as of any array in general is the fact that at a distinct or predefined region or position on said support or a surface thereof, a distinct polypeptide is immobilized. Because of this any activity at a distinct position or region of an array can be correlated with a specific polypeptide. The number of different hyperimmune serum reactive antigens and fragments thereof immobilized on a support may range from as little as 10 to several 1000 different hyperimmune serum reactive antigens and fragments thereof. The density of hyperimmune serum reactive antigens and fragments thereof per $cm^2$ is in a preferred embodiment as little as 10 peptides/polypeptides per $cm^2$ to at least 400 different peptides/polypeptides per $cm^2$ and more particularly at least 1000 different hyperimmune serum reactive antigens and fragments thereof per $cm^2$.

The manufacture of such arrays is known to the one skilled in the art and, for example, described in U.S. Pat. No. 5,744, 309. The array preferably comprises a planar, porous or non-porous solid support having at least a first surface. The hyperimmune serum reactive antigens and fragments thereof as disclosed herein, are immobilized on said surface. Preferred support materials are, among others, glass or cellulose. It is also within the present invention that the array is used for any of the diagnostic applications described herein. Apart from the hyperimmune serum reactive antigens and fragments thereof according to the present invention also the nucleic acid molecules according to the present invention may be used for the generation of an array as described above. This applies as well to an array made of antibodies, preferably monoclonal antibodies as, among others, described herein.

In a further aspect the present invention relates to an antibody directed to any of the hyperimmune serum reactive antigens and fragments thereof, derivatives or fragments thereof according to the present invention. The present invention includes, for example, monoclonal and polyclonal antibodies, chimeric, single chain, and humanized antibodies, as well as Fab fragments, or the product of a Fab expression library. It is within the present invention that the antibody may be chimeric, i. e. that different parts thereof stem from different species or at least the respective sequences are taken from different species.

Antibodies generated against the hyperimmune serum reactive antigens and fragments thereof corresponding to a sequence of the present invention can be obtained by direct injection of the hyperimmune serum reactive antigens and fragments thereof into an animal or by administering the hyperimmune serum reactive antigens and fragments thereof to an animal, preferably a non-human. The antibody so obtained will then bind the hyperimmune serum reactive antigens and fragments thereof itself. In this manner, even a sequence encoding only a fragment of a hyperimmune serum reactive antigen and fragments thereof can be used to generate antibodies binding the whole native hyperimmune serum reactive antigen and fragments thereof. Such antibodies can then be used to isolate the hyperimmune serum reactive antigens and fragments thereof from tissue expressing those hyperimmune serum reactive antigens and fragments thereof.

For preparation of monoclonal antibodies, any technique known in the art, which provides antibodies produced by continuous cell line cultures can be used (as described originally in {Kohler, G. et al., 1975}.

Techniques described for the production of single chain antibodies (U.S. Pat. No. 4,946,778) can be adapted to produce single chain antibodies to immunogenic hyperimmune serum reactive antigens and fragments thereof according to this invention. Also, transgenic mice, or other organisms such as other mammals, may be used to express humanized antibodies to immunogenic hyperimmune serum reactive antigens and fragments thereof according to this invention.

Alternatively, phage display technology or ribosomal display could be utilized to select antibody genes with binding activities towards the hyperimmune serum reactive antigens and fragments thereof either from repertoires of PCR amplified v-genes of lymphocytes from humans screened for possessing respective target antigens or from naïve libraries {McCafferty, J. et al., 1990}; {Marks, J. et al., 1992}. The affinity of these antibodies can also be improved by chain shuffling {Clackson, T. et al., 1991}.

If two antigen binding domains are present, each domain may be directed against a different epitope—termed 'bispecific' antibodies.

The above-described antibodies may be employed to isolate or to identify clones expressing the hyperimmune serum reactive antigens and fragments thereof or purify the hyperimmune serum reactive antigens and fragments thereof of the present invention by attachment of the antibody to a solid support for isolation and/or purification by affinity chromatography.

Thus, among others, antibodies against the hyperimmune serum reactive antigens and fragments thereof of the present invention may be employed to inhibit and/or treat infections, particularly bacterial infections and especially infections arising from S. agalactiae.

Hyperimmune serum reactive antigens and fragments thereof include antigenically, epitopically or immunologically equivalent derivatives, which form a particular aspect of this invention. The term "antigenically equivalent derivative" as used herein encompasses a hyperimmune serum reactive antigen and fragments thereof or its equivalent which will be specifically recognized by certain antibodies which, when raised to the protein or hyperimmune serum reactive antigen and fragments thereof according to the present invention, interfere with the interaction between pathogen and mammalian host. The term "immunologically equivalent derivative" as used herein encompasses a peptide or its equivalent which when used in a suitable formulation to raise antibodies in a vertebrate, the antibodies act to interfere with the interaction between pathogen and mammalian host.

The hyperimmune serum reactive antigens and fragments thereof, such as an antigenically or immunologically equivalent derivative or a fusion protein thereof can be used as an antigen to immunize a mouse or other animal such as a rat or chicken. The fusion protein may provide stability to the hyperimmune serum reactive antigens and fragments thereof. The antigen may be associated, for example by conjugation, with an immunogenic carrier protein, for example bovine serum albumin (BSA) or keyhole limpet haemocyanin (KLH). Alternatively, an antigenic peptide comprising multiple copies of the protein or hyperimmune serum reactive antigen and fragments thereof, or an antigenically or immunologically equivalent hyperimmune serum reactive antigen and fragments thereof, may be sufficiently antigenic to improve immunogenicity so as to obviate the use of a carrier.

Preferably the antibody or derivative thereof is modified to make it less immunogenic in the individual. For example, if the individual is human the antibody may most preferably be "humanized", wherein the complimentarity determining region(s) of the hybridoma-derived antibody has been transplanted into a human monoclonal antibody, for example as described in {Jones, P. et al., 1986} or {Tempest, P. et al., 1991}.

The use of a polynucleotide of the invention in genetic immunization will preferably employ a suitable delivery method such as direct injection of plasmid DNA into muscle, delivery of DNA complexed with specific protein carriers, coprecipitation of DNA with calcium phosphate, encapsulation of DNA in various forms of liposomes, particle bombardment {Tang, D. et al., 1992}, {Eisenbraun, M. et al., 1993} and in vivo infection using cloned retroviral vectors {Seeger, C. et al., 1984}.

In a further aspect the present invention relates to a peptide binding to any of the hyperimmune serum reactive antigens and fragments thereof according to the present invention, and a method for the manufacture of such peptides whereby the method is characterized by the use of the hyperimmune serum reactive antigens and fragments thereof according to the present invention and the basic steps are known to the one skilled in the art.

Such peptides may be generated by using methods according to the state of the art such as phage display or ribosome display. In case of phage display, basically a library of peptides is generated, in form of phages, and this kind of library is contacted with the target molecule, in the present case a hyperimmune serum reactive antigen and fragments thereof according to the present invention. Those peptides binding to the target molecule are subsequently removed, preferably as a complex with the target molecule, from the respective reaction. It is known to the one skilled in the art that the binding characteristics, at least to a certain extent, depend on the particularly realized experimental set-up such as the salt concentration and the like. After separating those peptides binding to the target molecule with a higher affinity or a bigger force, from the non-binding members of the library, and optionally also after removal of the target molecule from the complex of target molecule and peptide, the respective peptide(s) may subsequently be characterised. Prior to the characterisation optionally an amplification step is realized such as, e. g. by propagating the peptide encoding phages. The characterisation preferably comprises the sequencing of the target binding peptides. Basically, the peptides are not limited in their lengths, however, preferably peptides having a lengths from about 8 to 20 amino acids are preferably obtained in the respective methods. The size of the libraries may be about $10^2$ to $10^{18}$, preferably $10^8$ to $10^{15}$ different peptides, however, is not limited thereto.

A particular form of target binding hyperimmune serum reactive antigens and fragments thereof are the so-called "anticalines" which are, among others, described in German patent application DE 197 42 706.

In a further aspect the present invention relates to functional nucleic acids interacting with any of the hyperimmune serum reactive antigens and fragments thereof according to the present invention, and a method for the manufacture of such functional nucleic acids whereby the method is characterized by the use of the hyperimmune serum reactive antigens and fragments thereof according to the present invention and the basic steps are known to the one skilled in the art. The functional nucleic acids are preferably aptamers and spiegelmers.

Aptamers are D-nucleic acids, which are either single stranded or double stranded and which specifically interact with a target molecule. The manufacture or selection of aptamers is, e.g. described in European patent EP 0 533 838. Basically the following steps are realized. First, a mixture of nucleic acids, i. e. potential aptamers, is provided whereby each nucleic acid typically comprises a segment of several, preferably at least eight subsequent randomised nucleotides. This mixture is subsequently contacted with the target molecule whereby the nucleic acid(s) bind to the target molecule, such as based on an increased affinity towards the target or with a bigger force thereto, compared to the candidate mixture. The binding nucleic acid(s) are/is subsequently separated from the remainder of the mixture. Optionally, the thus obtained nucleic acid(s) is amplified using, e.g. polymerase chain reaction. These steps may be repeated several times giving at the end a mixture having an increased ratio of nucleic acids specifically binding to the target from which the final binding nucleic acid is then optionally selected. These specifically binding nucleic acid(s) are referred to as aptamers. It is obvious that at any stage of the method for the generation or identification of the aptamers samples of the mixture of individual nucleic acids may be taken to determine the sequence thereof using standard techniques. It is within the present invention that the aptamers may be stabilized such as, e. g., by introducing defined chemical groups which are known to the one skilled in the art of generating aptamers. Such modification may for example reside in the introduction of an amino group at the 2'-position of the sugar moiety of the nucleotides. Aptamers are currently used as therapeutical agents. However, it is also within the present invention that the thus selected or generated aptamers may be used for target validation and/or as lead substance for the development of medicaments, preferably of medicaments based on small molecules. This is actually done by a competition assay whereby the specific interaction between the target molecule and the aptamer is inhibited by a candidate drug whereby upon replacement of the aptamer from the complex of target and aptamer it may be assumed that the respective drug candidate allows a specific inhibition of the interaction between target and aptamer, and if the interaction is specific, said candidate drug will, at least in principle, be suitable to block the target and thus decrease its biological availability or activity in a respective system comprising such target. The thus obtained small molecule may then be subject to further derivatisation and modification to optimise its physical, chemical, biological and/or medical characteristics such as toxicity, specificity, biodegradability and bioavailability.

Spiegelmers and their generation or manufacture is based on a similar principle. The manufacture of spiegelmers is described in international patent application WO 98/08856. Spiegelmers are L-nucleic acids, which means that they are composed of L-nucleotides rather than D-nucleotides as aptamers are. Spiegelmers are characterized by the fact that they have a very high stability in biological systems and, comparable to aptamers, specifically interact with the target molecule against which they are directed. In the process of generating spiegelmers, a heterogenous population of D-nucleic acids is created and this population is contacted with the optical antipode of the target molecule, in the present case for example with the D-enantiomer of the naturally occurring L-enantiomer of the hyperimmune serum reactive antigens and fragments thereof according to the present invention. Subsequently, those D-nucleic acids are separated which do not interact with the optical antipode of the target molecule. But those D-nucleic acids interacting with the optical antipode of the target molecule are separated, optionally identified and/or sequenced and subsequently the corresponding L-nucleic acids are synthesized based on the nucleic acid sequence information obtained from the D-nucleic acids. These L-nucleic acids which are identical in terms of sequence with the aforementioned D-nucleic acids interacting with the optical antipode of the target molecule, will specifically interact with the naturally occurring target molecule rather than with the optical antipode thereof. Similar to the method for the generation of aptamers it is also possible to repeat the various steps several times and thus to enrich those nucleic acids specifically interacting with the optical antipode of the target molecule.

In a further aspect the present invention relates to functional nucleic acids interacting with any of the nucleic acid molecules according to the present invention, and a method for the manufacture of such functional nucleic acids whereby the method is characterized by the use of the nucleic acid molecules and their respective sequences according to the present invention and the basic steps are known to the one skilled in the art. The functional nucleic acids are preferably ribozymes, antisense oligonucleotides and siRNA.

Ribozymes are catalytically active nucleic acids, which preferably consist of RNA, which basically comprises two moieties. The first moiety shows a catalytic activity whereas the second moiety is responsible for the specific interaction with the target nucleic acid, in the present case the nucleic acid coding for the hyperimmune serum reactive antigens and fragments thereof according to the present invention. Upon interaction between the target nucleic acid and the second moiety of the ribozyme, typically by hybridisation and Watson-Crick base pairing of essentially complementary stretches of bases on the two hybridising strands, the catalytically active moiety may become active which means that it catalyses, either intramolecularly or intermolecularly, the target nucleic acid in case the catalytic activity of the ribozyme is a phosphodiesterase activity. Subsequently, there may be a further degradation of the target nucleic acid, which in the end results in the degradation of the target nucleic acid as well as the protein derived from the said target nucleic acid. Ribozymes, their use and design principles are known to the one skilled in the art, and, for example described in {Doherty, E. et al., 2001} and {Lewin, A. et al., 2001}.

The activity and design of antisense oligonucleotides for the manufacture of a medicament and as a diagnostic agent, respectively, is based on a similar mode of action. Basically, antisense oligonucleotides hybridize based on base complementarity, with a target RNA, preferably with a mRNA, thereby activating RNase H. RNase H is activated by both phosphodiester and phosphorothioate-coupled DNA. Phosphodiester-coupled DNA, however, is rapidly degraded by cellular nucleases with the exception of phosphorothioate-coupled DNA. These resistant, non-naturally occurring DNA derivatives do not inhibit RNase H upon hybridisation with RNA. In other words, antisense polynucleotides are only effective as DNA RNA hybride complexes. Examples for this kind of antisense oligonucleotides are described, among others, in U.S. Pat. No. 5,849,902 and U.S. Pat. No. 5,989,912. In other words, based on the nucleic acid sequence of the target molecule which in the present case are the nucleic acid molecules for the hyperimmune serum reactive antigens and fragments thereof according to the present invention, either from the target protein from which a respective nucleic acid sequence may in principle be deduced, or by knowing the nucleic acid sequence as such, particularly the mRNA, suitable antisense oligonucleotides may be designed base on the principle of base complementarity.

Particularly preferred are antisense-oligonucleotides, which have a short stretch of phosphorothioate DNA (3 to 9 bases). A minimum of 3 DNA bases is required for activation of bacterial RNase H and a minimum of 5 bases is required for mammalian RNase H activation. In these chimeric oligonucleotides there is a central region that forms a substrate for RNase H that is flanked by hybridising "arms" comprised of modified nucleotides that do not form substrates for RNase H. The hybridising arms of the chimeric oligonucleotides may be modified such as by 2'-O-methyl or 2'-fluoro. Alternative approaches used methylphosphonate or phosphoramidate linkages in said arms. Further embodiments of the antisense oligonucleotide useful in the practice of the present invention are P-methoxyoligonucleotides, partial P-methoxyoligodeoxyribonucleotides or P-methoxyoligonucleotides.

Of particular relevance and usefulness for the present invention are those antisense oligonucleotides as more particularly described in the above two mentioned U.S. patents. These oligonucleotides contain no naturally occurring 5'→3'-linked nucleotides. Rather the oligonucleotides have two types of nucleotides: 2'-deoxyphosphorothioate, which activate RNase H, and 2'-modified nucleotides, which do not. The linkages between the 2'-modified nucleotides can be phosphodiesters, phosphorothioate or P-ethoxyphosphodiester. Activation of RNase H is accomplished by a contiguous RNase H-activating region, which contains between 3 and 5 2'-deoxyphosphorothioate nucleotides to activate bacterial RNase H and between 5 and 10 2'- deoxyphosphorothioate nucleotides to activate eucaryotic and, particularly, mammalian RNase H. Protection from degradation is accomplished by making the 5' and 3' terminal bases highly nuclease resistant and, optionally, by placing a 3' terminal blocking group.

More particularly, the antisense oligonucleotide comprises a 5' terminus and a 3' terminus; and from position 11 to 59 5'→3'-linked nucleotides independently selected from the group consisting of 2'-modified phosphodiester nucleotides and 2'-modified P-alkyloxyphosphotriester nucleotides; and wherein the 5'-terminal nucleoside is attached to an RNase H-activating region of between three and ten contiguous phosphorothioate-linked deoxyribonucleotides, and wherein the 3'-terminus of said oligonucleotide is selected from the group consisting of an inverted deoxyribonucleotide, a contiguous stretch of one to three phosphorothioate 2'-modified ribonucleotides, a biotin group and a P-alkyloxyphosphotriester nucleotide.

Also an antisense oligonucleotide may be used wherein not the 5' terminal nucleoside is attached to an RNase H-activating region but the 3' terminal nucleoside as specified above. Also, the 5' terminus is selected from the particular group rather than the 3' terminus of said oligonucleotide.

The nucleic acids as well as the hyperimmune serum reactive antigens and fragments thereof according to the present invention may be used as or for the manufacture of pharmaceutical compositions, especially vaccines. Preferably such pharmaceutical composition, preferably vaccine is for the prevention or treatment of diseases caused by, related to or associated with *S. agalactiae*. In so far another aspect of the invention relates to a method for inducing an immunological response in an individual, particularly a mammal, which comprises inoculating the individual with the hyperimmune serum reactive antigens and fragments thereof of the invention, or a fragment or variant thereof, adequate to produce antibodies to protect said individual from infection, particularly streptococcal infection and most particularly *S. agalactiae* infections.

Yet another aspect of the invention relates to a method of inducing an immunological response in an individual which comprises, through gene therapy or otherwise, delivering a nucleic acid functionally encoding hyperimmune serum reactive antigens and fragments thereof, or a fragment or a variant thereof, for expressing the hyperimmune serum reactive antigens and fragments thereof, or a fragment or a variant thereof in vivo in order to induce an immunological response to produce antibodies or a cell mediated T cell response, either cytokine-producing T cells or cytotoxic T cells, to protect said individual from disease, whether that disease is already established within the individual or not. One-way of administering the gene is by accelerating it into the desired cells as a coating on particles or otherwise.

A further aspect of the invention relates to an immunological composition which, when introduced into a host capable of having induced within it an immunological response, induces an immunological response in such host, wherein the composition comprises recombinant DNA which codes for and expresses an antigen of the hyperimmune serum reactive antigens and fragments thereof of the present invention. The immunological response may be used therapeutically or prophylactically and may take the form of antibody immunity or cellular immunity such as that arising from CTL or CD4+T cells.

The hyperimmune serum reactive antigens and fragments thereof of the invention or a fragment thereof may be fused with a co-protein which may not by itself produce antibodies, but is capable of stabilizing the first protein and producing a fused protein which will have immunogenic and protective properties. This fused recombinant protein preferably further comprises an antigenic co-protein, such as Glutathione-S-transferase (GST) or beta-galactosidase, relatively large co-proteins which solubilise the protein and facilitate production and purification thereof. Moreover, the co-protein may act as an adjuvant in the sense of providing a generalized stimulation of the immune system. The co-protein may be attached to either the amino or carboxy terminus of the first protein.

Also, provided by this invention are methods using the described nucleic acid molecule or particular fragments thereof in such genetic immunization experiments in animal models of infection with S. agalactiae. Such fragments will be particularly useful for identifying protein epitopes able to provoke a prophylactic or therapeutic immune response. This approach can allow for the subsequent preparation of monoclonal antibodies of particular value from the requisite organ of the animal successfully resisting or clearing infection for the development of prophylactic agents or therapeutic treatments of S. agalactiae infection in mammals, particularly humans.

The hyperimmune serum reactive antigens and fragments thereof may be used as an antigen for vaccination of a host to produce specific antibodies which protect against invasion of bacteria, for example by blocking adherence of bacteria to damaged tissue. Examples of tissue damage include wounds in skin or connective tissue and mucosal tissues caused e.g. by viral infection (esp. respiratory, such as the flu) mechanical, chemical or thermal damage or by implantation of indwelling devices, or wounds in the mucous membranes, such as the mouth, mammary glands, urethra or vagina.

The present invention also includes a vaccine formulation, which comprises the immunogenic recombinant protein together with a suitable carrier. Since the protein may be broken down in the stomach, it is preferably administered parenterally, including, for example, administration that is subcutaneous, intramuscular, intravenous, intradermal intranasal or transdermal Formulations suitable for parenteral administration include aqueous and non-aqueous sterile injection solutions which may contain anti-oxidants, buffers, bacteriostats and solutes which render the formulation isotonic with the bodily fluid, preferably the blood, of the individual; and aqueous and non-aqueous sterile suspensions which may include suspending agents or thickening agents. The formulations may be presented in unit-dose or multi-dose containers, for example, sealed ampoules and vials, and may be stored in a freeze-dried condition requiring only the addition of the sterile liquid carrier immediately prior to use. The vaccine formulation may also include adjuvant systems for enhancing the immunogenicity of the formulation, such as oil-in-water systems and other systems known in the art. The dosage will depend on the specific activity of the vaccine and can be readily determined by routine experimentation.

According to another aspect, the present invention relates to a pharmaceutical composition comprising such a hyperimmune serum-reactive antigen or a fragment thereof as provided in the present invention for S. agalactiae. Such a pharmaceutical composition may comprise one preferably at least two or more hyperimmune serum reactive antigens or fragments thereof against S. agalactiae. Optionally, such S. agalactiae hyperimmune serum reactive antigens or fragments thereof may also be combined with antigens against other pathogens in a combination pharmaceutical composition. Preferably, said pharmaceutical composition is a vaccine for preventing or treating an infection caused by S. agalactiae and/or other pathogens against which the antigens have been included in the vaccine.

According to a further aspect, the present invention relates to a pharmaceutical composition comprising a nucleic acid molecule encoding a hyperimmune serum-reactive antigen or a fragment thereof as identified above for S. agalactiae. Such a pharmaceutical composition may comprise one or more nucleic acid molecules encoding hyperimmune serum reactive antigens or fragments thereof against S. agalactiae. Optionally, such S. agalactiae nucleic acid molecules encoding hyperimmune serum reactive antigens or fragments thereof may also be combined with nucleic acid molecules encoding antigens against other pathogens in a combination pharmaceutical composition. Preferably, said pharmaceutical composition is a vaccine for preventing or treating an infection caused by S. agalactiae and/or other pathogens against which the antigens have been included in the vaccine.

The pharmaceutical composition may contain any suitable auxiliary substances, such as buffer substances, stabilisers or further active ingredients, especially ingredients known in connection of pharmaceutical composition and/or vaccine production.

A preferable carrier/or excipient for the hyperimmune serum-reactive antigens, fragments thereof or a coding nucleic acid molecule thereof according to the present invention is an immunostimulatory compound for further stimulating the immune response to the given hyperimmune serum-reactive antigen, fragment thereof or a coding nucleic acid molecule thereof. Preferably the immunostimulatory compound in the pharmaceutical preparation according to the present invention is selected from the group of polycationic substances, especially polycationic peptides, immunostimulatory nucleic acids molecules, preferably immunostimulatory deoxynucleotides, alum, Freund's complete adjuvants, Freund's incomplete adjuvants, neuroactive compounds, especially human growth hormone, or combinations thereof.

It is also within the scope of the present invention that the pharmaceutical composition, especially vaccine, comprises apart from the hyperimmune serum reactive antigens, fragments thereof and/or coding nucleic acid molecules thereof according to the present invention other compounds which are biologically or pharmaceutically active. Preferably, the vaccine composition comprises at least one polycationic peptide. The polycationic compound(s) to be used according to the present invention may be any polycationic compound, which shows the characteristic effects according to the WO 97/30721. Preferred polycationic compounds are selected from basic polypeptides, organic polycations, basic polyamino acids or mixtures thereof. These polyamino acids should have a chain length of at least 4 amino acid residues (WO 97/30721). Especially preferred are substances like polylysine, polyarginine and polypeptides containing more than 20%, especially more than 50% of basic amino acids in a range of more than 8, especially more than 20, amino acid residues or mixtures thereof. Other preferred polycations and their pharmaceutical compositions are described in WO 97/30721 (e.g. polyethyleneimine) and WO 99/38528. Preferably these polypeptides contain between 20 and 500 amino acid residues, especially between 30 and 200 residues.

These polycationic compounds may be produced chemically or recombinantly or may be derived from natural sources.

Cationic (poly)peptides may also be anti-microbial with properties as reviewed in {Ganz, T., 1999}. These (poly) peptides may be of prokaryotic or animal or plant origin or may be produced chemically or recombinantly (WO 02/13857). Peptides may also belong to the class of defensins (WO 02/13857). Sequences of such peptides can be, for example, found in the Antimicrobial Sequences Database under the following internet address:

http://www.bbcm.univ.trieste.it/-tossi/pag2.html

Such host defense peptides or defensives are also a preferred form of the polycationic polymer according to the present invention. Generally, a compound allowing us an end product activation (or down-regulation) of the adaptive immune system, preferably mediated by APCs (including dendritic cells) is used as polycationic polymer.

Especially preferred for use as polycationic substances in the present invention are cathelicidin derived antimicrobial peptides or derivatives thereof (International patent application WO 02/13857, incorporated herein by reference), especially antimicrobial peptides derived from mammalian cathelicidin, preferably from human, bovine or mouse.

Polycationic compounds derived from natural sources include HIV-REV or HIV-TAT (derived cationic peptides, antennapedia peptides, chitosan or other derivatives of chitin) or other peptides derived from these peptides or proteins by biochemical or recombinant production. Other preferred polycationic compounds are cathelin or related or derived substances from cathelin. For example, mouse cathelin is a peptide which has the amino acid sequence $NH_2$-RLAGLL-RKGGEKIGEKLKKIGQKIKNFFQKLVPQPECOOH (SEQ ID NO:488). Related or derived cathelin substances contain the whole or parts of the cathelin sequence with at least 15-20 amino acid residues. Derivations may include the substitution or modification of the natural amino acids by amino acids which are not among the 20 standard amino acids. Moreover, further cationic residues may be introduced into such cathelin molecules. These cathelin molecules are preferred to be combined with the antigen. These cathelin molecules surprisingly have turned out to be also effective as an adjuvant for an antigen without the addition of further adjuvants. It is therefore possible to use such cathelin molecules as efficient adjuvants in vaccine formulations with or without further immunoactivating substances.

Another preferred polycationic substance to be used according to the present invention is a synthetic peptide containing at least 2 KLK-motifs separated by a linker of 3 to 7 hydrophobic amino acids (International patent application WO 02/32451, incorporated herein by reference).

The pharmaceutical composition of the present invention may further comprise immunostimulatory nucleic acid(s). Immunostimulatory nucleic acids are e.g. neutral or artificial CpG containing nucleic acids, short stretches of nucleic acids derived from non-vertebrates or in form of short oligonucleotides (ODNs) containing non-methylated cytosine-guanine di-nucleotides (CpG) in a certain base context (e.g. described in WO 96/02555). Alternatively, also nucleic acids based on inosine and cytidine as e.g. described in the WO 01/93903, or deoxynucleic acids containing deoxy-inosine and/or deoxy-yuridine residues (described in WO 01/93905 and PCT/EP 02/05448, incorporated herein by reference) may preferably be used as immunostimulatory nucleic acids for the present invention. Preferably, the mixtures of different immunostimulatory nucleic acids may be used according to the present invention.

It is also within the present invention that any of the aforementioned polycationic compounds is combined with any of the immunostimulatory nucleic acids as aforementioned. Preferably, such combinations are according to the ones as described in WO 01/93905, WO 02/32451, WO 01/54720, WO 01/93903, WO 02/13857 and PCT/EP 02/05448 and the Austrian patent application A 1924/2001, incorporated herein by reference.

In addition or alternatively such vaccine composition may comprise apart from the hyperimmune serum reactive antigens and fragments thereof, and the coding nucleic acid molecules thereof according to the present invention a neuroactive compound. Preferably, the neuroactive compound is human growth factor as, e.g. described in WO 01/24822. Also preferably, the neuroactive compound is combined with any of the polycationic compounds and/or immunostimulatory nucleic acids as afore-mentioned.

In a further aspect the present invention is related to a pharmaceutical composition. Such pharmaceutical composition is, for example, the vaccine described herein. Also a pharmaceutical composition is a pharmaceutical composition which comprises any of the following compounds or combinations thereof: the nucleic acid molecules according to the present invention, the hyperimmune serum reactive antigens and fragments thereof according to the present invention, the vector according to the present invention, the cells according to the present invention, the antibody according to the present invention, the functional nucleic acids according to the present invention and the binding peptides such as the anticalines according to the present invention, any agonists and antagonists screened as described herein. In connection therewith any of these compounds may be employed in combination with a non-sterile or sterile carrier or carriers for use with cells, tissues or organisms, such as a pharmaceutical carrier suitable for administration to a subject. Such compositions comprise, for instance, a media additive or a therapeutically effective amount of a hyperimmune serum reactive antigen and fragments thereof of the invention and a pharmaceutically acceptable carrier or excipient. Such carriers may include, but are not limited to, saline, buffered saline, dextrose, water, glycerol, ethanol and combinations thereof. The formulation should suit the mode of administration.

The pharmaceutical compositions may be administered in any effective, convenient manner including, for instance, administration by topical, oral, anal, vaginal, intravenous, intraperitoneal, intramuscular, subcutaneous, intranasal, intratracheal or intradermal routes among others.

In therapy or as a prophylactic, the active agent may be administered to an individual as an injectable composition, for example as a sterile aqueous dispersion, preferably isotonic.

Alternatively the composition may be formulated for topical application, for example in the form of ointments, creams, lotions, eye ointments, eye drops, ear drops, mouthwash, impregnated dressings and sutures and aerosols, and may contain appropriate conventional additives, including, for example, preservatives, solvents to assist drug penetration, and emollients in ointments and creams. Such topical formulations may also contain compatible conventional carriers, for example cream or ointment bases, and ethanol or oleyl alcohol for lotions. Such carriers may constitute from about 1% to about 98% by weight of the formulation; more usually they will constitute up to about 80% by weight of the formulation.

In addition to the therapy described above, the compositions of this invention may be used generally as a wound treatment agent to prevent adhesion of bacteria to matrix proteins exposed in wound tissue and for prophylactic use in dental treatment as an alternative to, or in conjunction with, antibiotic prophylaxis.

A vaccine composition is conveniently in injectable form. Conventional adjuvants may be employed to enhance the immune response. A suitable unit dose for vaccination is 0.05-5 µg antigen/per kg of body weight, and such dose is preferably administered 1-3 times and with an interval of 1-3 weeks.

With the indicated dose range, no adverse toxicological effects should be observed with the compounds of the invention, which would preclude their administration to suitable individuals.

In a further embodiment the present invention relates to diagnostic and pharmaceutical packs and kits comprising one or more containers filled with one or more of the ingredients of the aforementioned compositions of the invention. The ingredient(s) can be present in a useful amount, dosage, formulation or combination. Associated with such container(s) can be a notice in the form prescribed by a governmental agency regulating the manufacture, use or sale of pharmaceuticals or biological products, reflecting approval by the agency of the manufacture, use or sale of the product for human administration.

In connection with the present invention any disease related use as disclosed herein such as, e. g. use of the pharmaceutical composition or vaccine, is particularly a disease or diseased condition which is caused by, linked or associated with Streptococci, more preferably, S. pyogens and pneumoniae. In connection therewith it is to be noted that S. agalactiae comprises several strains including those disclosed herein. A disease related, caused or associated with the bacterial infection to be prevented and/or treated according to the present invention includes besides others bacterial pharyngitis, otitis media, pneumonia, bacteremia, meningitis, peritonitis, wound infection and sepsis in humans.

In a still further embodiment the present invention is related to a screening method using any of the hyperimmune serum reactive antigens or nucleic acids according to the present invention. Screening methods as such are known to the one skilled in the art and can be designed such that an agonist or an antagonist is screened. Preferably an antagonist is screened which in the present case inhibits or prevents the binding of any hyperimmune serum reactive antigen and fragment thereof according to the present invention to an interaction partner. Such interaction partner can be a naturally occurring interaction partner or a non-naturally occurring interaction partner.

The invention also provides a method of screening compounds to identify those, which enhance (agonist) or block (antagonist) the function of hyperimmune serum reactive antigens and fragments thereof or nucleic acid molecules of the present invention, such as its interaction with a binding molecule. The method of screening may involve high-throughput.

For example, to screen for agonists or antagonists, the interaction partner of the nucleic acid molecule and nucleic acid, respectively, according to the present invention, maybe a synthetic reaction mix, a cellular compartment, such as a membrane, cell envelope or cell wall, or a preparation of any thereof, may be prepared from a cell that expresses a molecule that binds to the hyperimmune serum reactive antigens and fragments thereof of the present invention. The preparation is incubated with labelled hyperimmune serum reactive antigens and fragments thereof in the absence or the presence of a candidate molecule, which may be an agonist or antagonist. The ability of the candidate molecule to bind the binding molecule is reflected in decreased binding of the labelled ligand. Molecules which bind gratuitously, i. e., without inducing the functional effects of the hyperimmune serum reactive antigens and fragments thereof, are most likely to be good antagonists. Molecules that bind well and elicit functional effects that are the same as or closely related to the hyperimmune serum reactive antigens and fragments thereof are good agonists.

The functional effects of potential agonists and antagonists may be measured, for instance, by determining the activity of a reporter system following interaction of the candidate molecule with a cell or appropriate cell preparation, and comparing the effect with that of the hyperimmune serum reactive antigens and fragments thereof of the present invention or molecules that elicit the same effects as the hyperimmune serum reactive antigens and fragments thereof. Reporter systems that may be useful in this regard include but are not limited to colorimetric labelled substrate converted into product, a reporter gene that is responsive to changes in the functional activity of the hyperimmune serum reactive antigens and fragments thereof, and binding assays known in the art.

Another example of an assay for antagonists is a competitive assay that combines the hyperimmune serum reactive antigens and fragments thereof of the present invention and a potential antagonist with membrane-bound binding molecules, recombinant binding molecules, natural substrates or ligands, or substrate or ligand mimetics, under appropriate conditions for a competitive inhibition assay. The hyperimmune serum reactive antigens and fragments thereof can be labelled such as by radioactivity or a colorimetric compound, such that the molecule number of hyperimmune serum reactive antigens and fragments thereof bound to a binding molecule or converted to product can be determined accurately to assess the effectiveness of the potential antagonist.

Potential antagonists include small organic molecules, peptides, polypeptides and antibodies that bind to a hyperimmune serum reactive antigen and fragments thereof of the invention and thereby inhibit or extinguish its activity. Potential antagonists also may be small organic molecules, a peptide, a polypeptide such as a closely related protein or antibody that binds to the same sites on a binding molecule without inducing functional activity of the hyperimmune serum reactive antigens and fragments thereof of the invention.

Potential antagonists include a small molecule, which binds to and occupies the binding site of the hyperimmune serum reactive antigens and fragments thereof thereby preventing binding to cellular binding molecules, such that normal biological activity is prevented. Examples of small molecules include but are not limited to small organic molecules, peptides or peptide-like molecules.

Other potential antagonists include antisense molecules (see {Okano, H. et al., 1991}; OLIGODEOXYNUCLEOTIDES AS ANTISENSE INHIBITORS OF GENE EXPRESSION; CRC Press, Boca Ration, Fla. (1988), for a description of these molecules).

Preferred potential antagonists include derivatives of the hyperimmune serum reactive antigens and fragments thereof of the invention.

As used herein the activity of a hyperimmune serum reactive antigen and fragment thereof according to the present invention is its capability to bind to any of its interaction partner or the extent of such capability to bind to its or any interaction partner.

In a particular aspect, the invention provides the use of the hyperimmune serum reactive antigens and fragments thereof, nucleic acid molecules or inhibitors of the invention to interfere with the initial physical interaction between a pathogen and mammalian host responsible for sequelae of infection. In particular the molecules of the invention may be used: i) in the prevention of adhesion of S. agalactiae to mammalian extracellular matrix proteins at mucosal surfaces and on in-dwelling devices or to extracellular matrix proteins in wounds; ii) to block bacterial adhesion between mammalian extracellular matrix proteins and bacterial proteins which mediate tissue damage or invasion iii) or lead to evasion of immune defense; iv) to block the normal progression of pathogenesis in infections initiated other than by the implantation of in-dwelling devices or by other surgical techniques, e.g. through inhibiting nutrient acquisition.

Each of the DNA coding sequences provided herein may be used in the discovery and development of antibacterial compounds. The encoded protein upon expression can be used as a target for the screening of antibacterial drugs. Additionally, the DNA sequences encoding the amino terminal regions of the encoded protein or Shine-Delgarno or other translation facilitating sequences of the respective mRNA can be used to construct antisense sequences to control the expression of the coding sequence of interest.

The antagonists and agonists may be employed, for instance, to inhibit diseases arising from infection with Streptococcus, especially S. agalactiae, such as sepsis.

In a still further aspect the present invention is related to an affinity device such affinity device comprises as least a support material and any of the hyperimmune serum reactive antigens and fragments thereof according to the present invention, which is attached to the support material. Because of the specificity of the hyperimmune serum reactive antigens and fragments thereof according to the present invention for their target cells or target molecules or their interaction partners, the hyperimmune serum reactive antigens and fragments thereof allow a selective removal of their interaction partner(s) from any kind of sample applied to the support material provided that the conditions for binding are met. The sample may be a biological or medical sample, including but not limited to, fermentation broth, cell debris, cell preparation, tissue preparation, organ preparation, blood, urine, lymph liquid, liquor and the like.

The hyperimmune serum reactive antigens and fragments thereof may be attached to the matrix in a covalent or non-covalent manner. Suitable support material is known to the one skilled in the art and can be selected from the group comprising cellulose, silicon, glass, aluminium, paramagnetic beads, starch and dextrane.

The present invention is further illustrated by the following figures, examples and the sequence listing, from which further features, embodiments and advantages may be taken. It is to be understood that the present examples are given by way of illustration only and not by way of limitation of the disclosure.

In connection with the present invention

Table 1A shows the summary of all screens performed with genomic S. agalactiae libraries and human serum. Table 1B shows antigenic proteins identified by sequence identity within antigenic regions of the proteins listed in Table 1A.

Table 2 shows the summary of epitope serology analysis with human sera.

Table 3 shows the summary of the gene distribution analysis for the identified antigens in 46 S. agalactiae strains.

Table 4 shows the summary of mouse immunogenicity experiments.

Table 5 shows the summary of all screens performed with genomic S. agalactiae libraries and human serum.

Table 6 shows the summary of epitope serology analysis with human sera.

Table 7 shows the summary of mouse immunogenicity experiments.

The figures to which it might be referred to in the specification are described in the following in more details.

Figure 1:
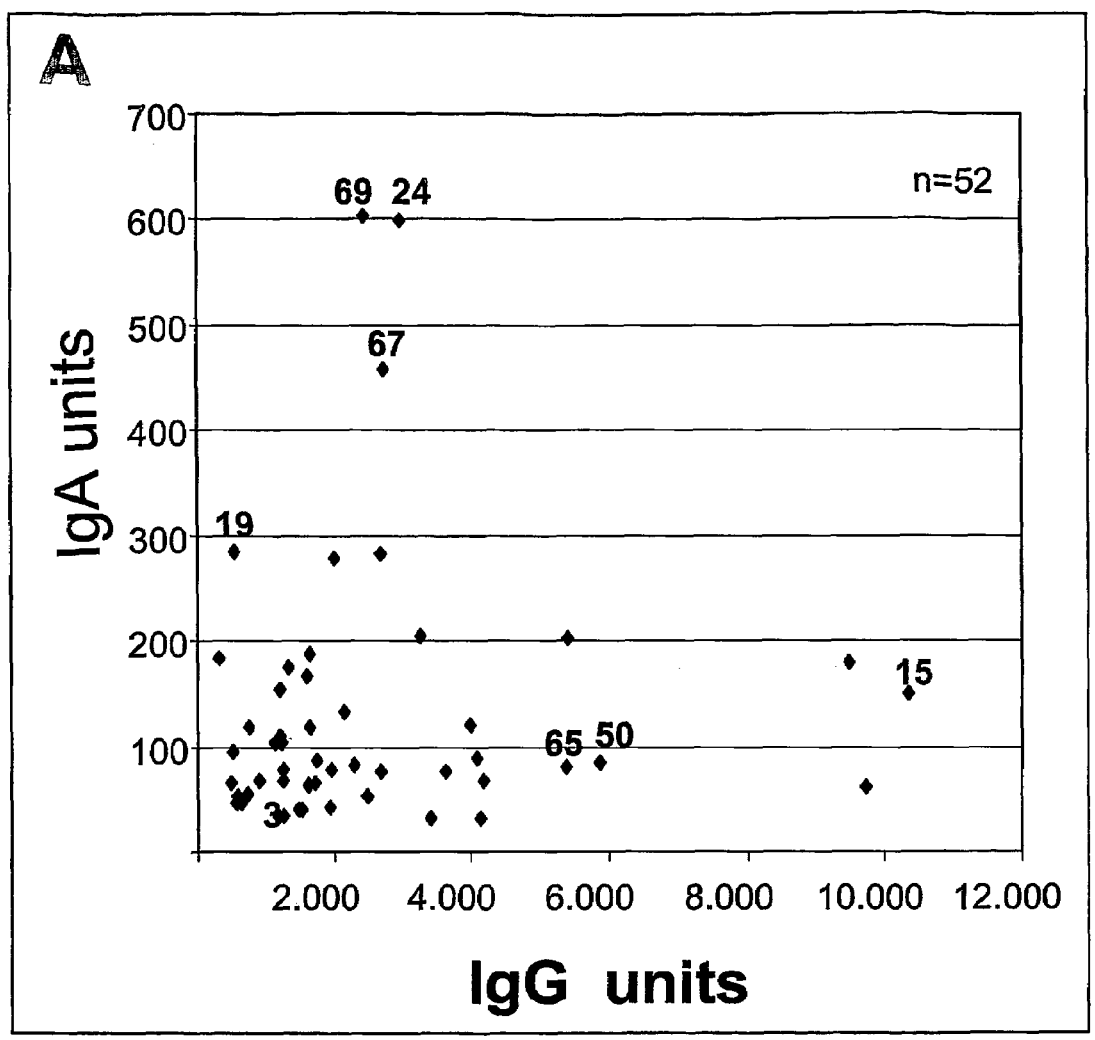
FIG. 1 shows the characterization of human antibody sources for S. agalactiae.
Figure 1:
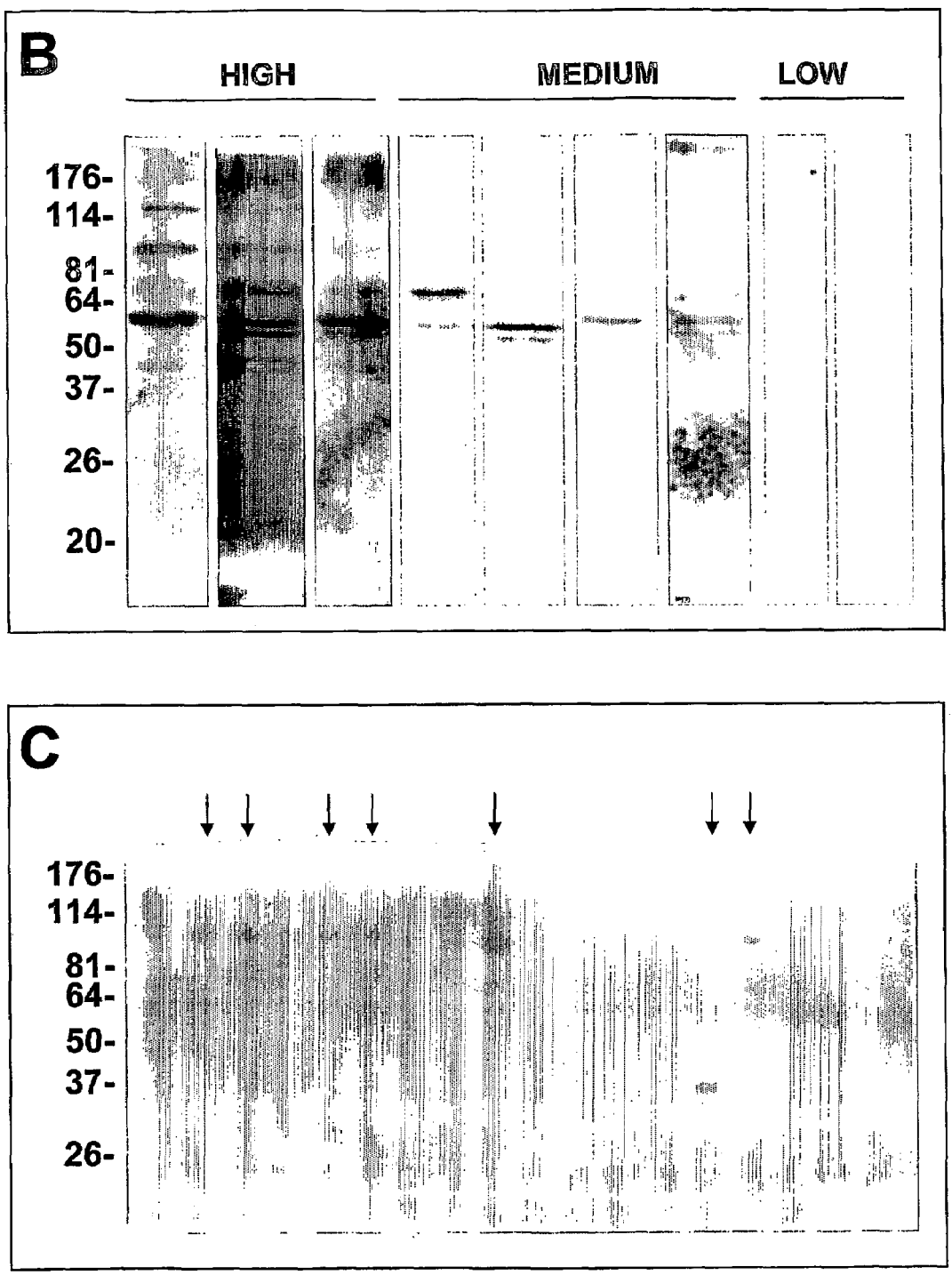

FIG. 1 shows the characterization of human sera and cervical secretions for anti-S. agalactiae antibodies as measured by immune assays. Total anti-S. agalactiae IgG and IgA antibody levels were measured by standard ELISA using total bacterial lysates or culture supernant fractions prepared; from S. agalactiae serotype III strain ATCC 12403 as coating antigens. (A) Results of representative experiments are shown with healthy adult sera with total bacterial lysate proteins. Data are expressed as ELISA units calculated from absorbance at 405 nm at a serum dilution in the linear range of detection (2.000× for IgA, 10,000 for IgG). Selected sera (out of 52) included in the healthy adult non-pregnant serum pool (NSag8-IgG,-IgA) are indicated by bold numbers. (B) Immunoblot analysis was performed on high titer sera selected by ELISA in order to ensure multiple immune reactivity with protein antigens. Results of a representative experiment using total bacterial lysate prepared from S. agalactiae serotype III ATCC 12403 strain and selected patients' sera at 5.000× dilution are shown. Blots were developed with anti-human IgG secondary antibody reagent. Low titer sera were included as negative controls. Mw: molecular weight markers. (C) shows selection of cervical secretions from noncolonized pregnant women by immunoblot analysis. Antibodies extracted from cervical wicks were quantitated for IgA content. 2 µg IgA from each preparations were tested for immunoreactivity using total bacterial lysate in a multi-well blotting apparatus. Blots were developed with anti-human IgA secondary antibodies. IgA preparation showing reactivity with GBS proteins (indicated by arrows) were selected and pooled.

FIG. 2(A) shows the fragment size distribution of the Streptococcus agalactiae ATCC 12403 small fragment genomic library, LSAg-70. After sequencing 576 randomly selected clones, sequences were trimmed (464) to eliminate vector residues and the numbers of clones with various genomic fragment sizes were plotted. (B) shows the graphic illustration of the distribution of the same set of randomly sequenced clones of LSAg-70 over the S. agalactiae ATCC 12403 chromosome. Rectangles indicate matching sequences to annotated ORFs and diamonds represent fully matched clones to non-coding chromosomal sequences in +/+ or +/− orientation. Circles position all clones with chimeric sequences. Numeric distances in base pairs are indicated over the circular genome for orientation. Partitioning of various clone sets within the library is given in numbers and percentage at the bottom of the figure.

Figure 3:
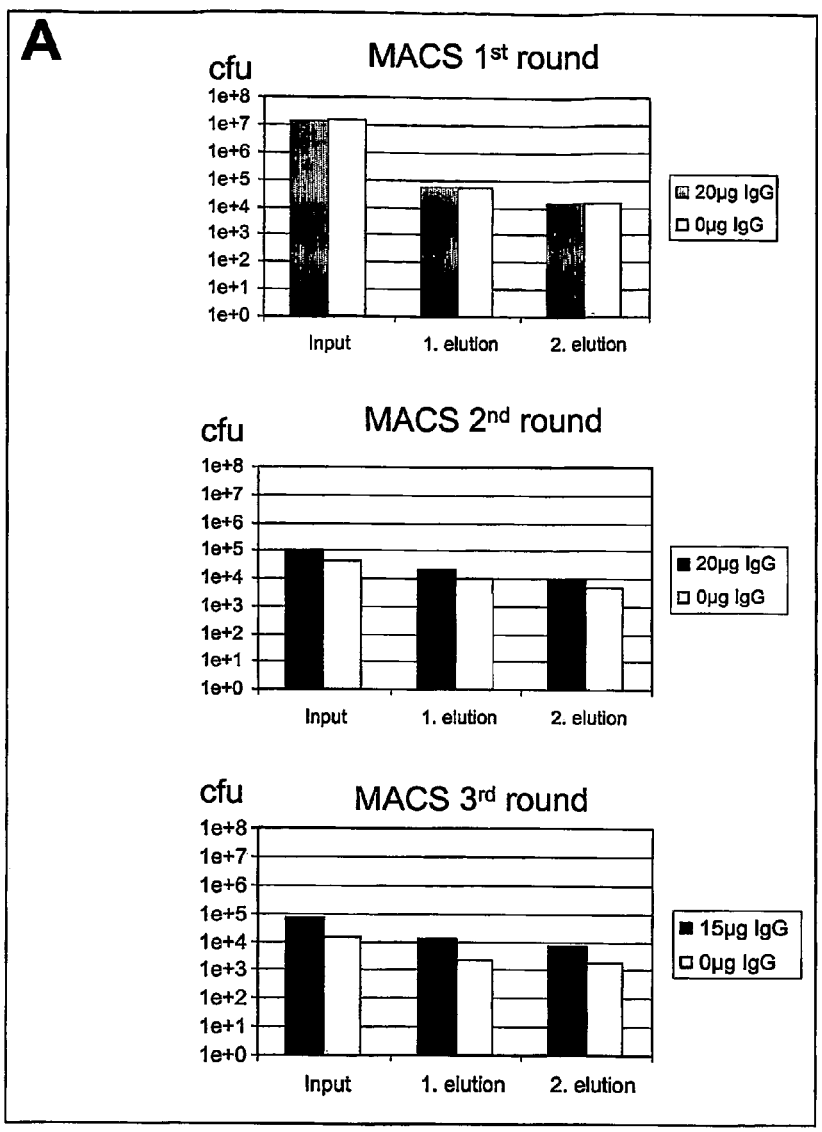
FIG. 3 shows the selection of bacterial cells by MACS using biotinylated human IgGs.
Figure 3:
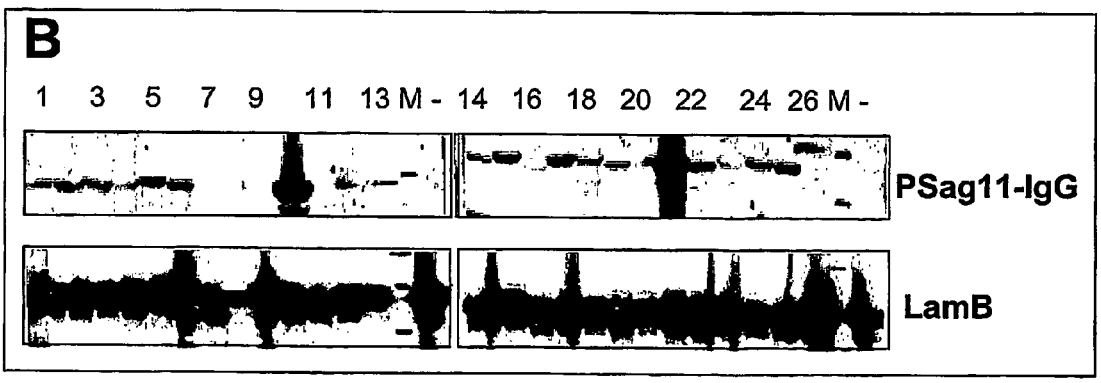

FIG. 3(A) shows the MACS selection with biotinylated human IgGs. The LSAg-70 library in pMAL9.1 was screened with 15-20 μg biotinylated IgG (PSag11-IgG, purified from human serum). As negative control, no serum was added to the library cells for screening. Number of cells selected after the 1$^{st}$, 2$^{nd}$ and 3$^{rd}$ elution are shown for each selection round (upper, middle and lower panel, respectively). (B) shows the reactivity of specific clones (1-26) selected by bacterial surface display as analyzed by immunoblot analysis with the human serum IgG pool (PSag11-IgG, 4 μg/μl) used for selection by MACS at a dilution of 1:3,000. As a loading control the same blot was also analyzed with antibodies directed against the platform protein LamB at a dilution of 1:5,000 of hyperimmune rabbit serum. M, Molecular weight marker; L, Extract from a clone expressing LamB without foreign peptide insert.

Figure 4:
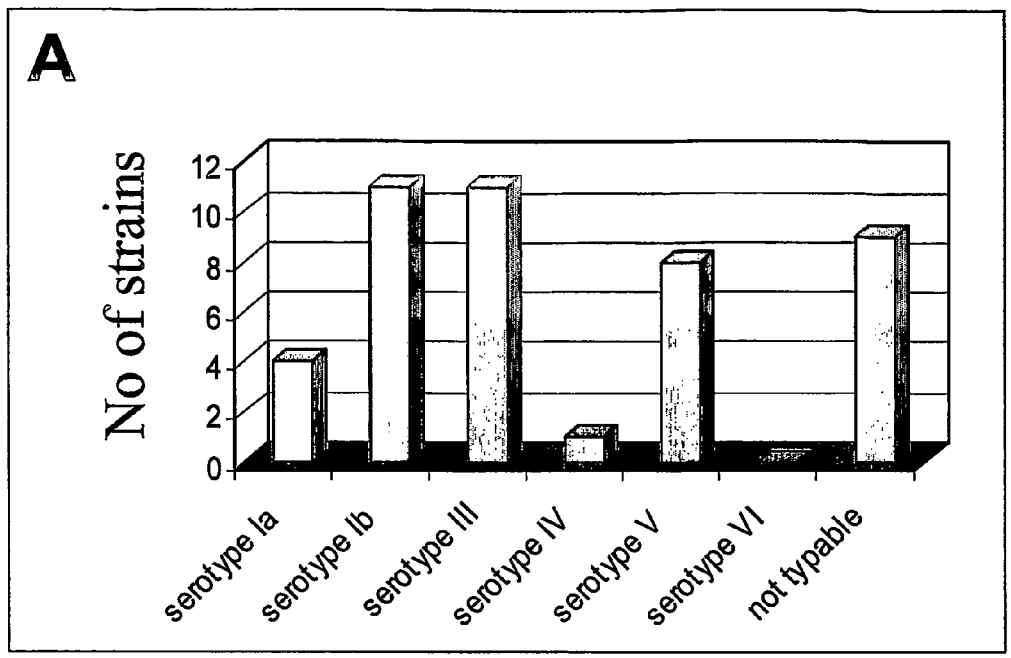
FIG. 4 shows the serotypes of the applied strains and an example for the gene distribution analysis with one of the identified antigens.
Figure 4:
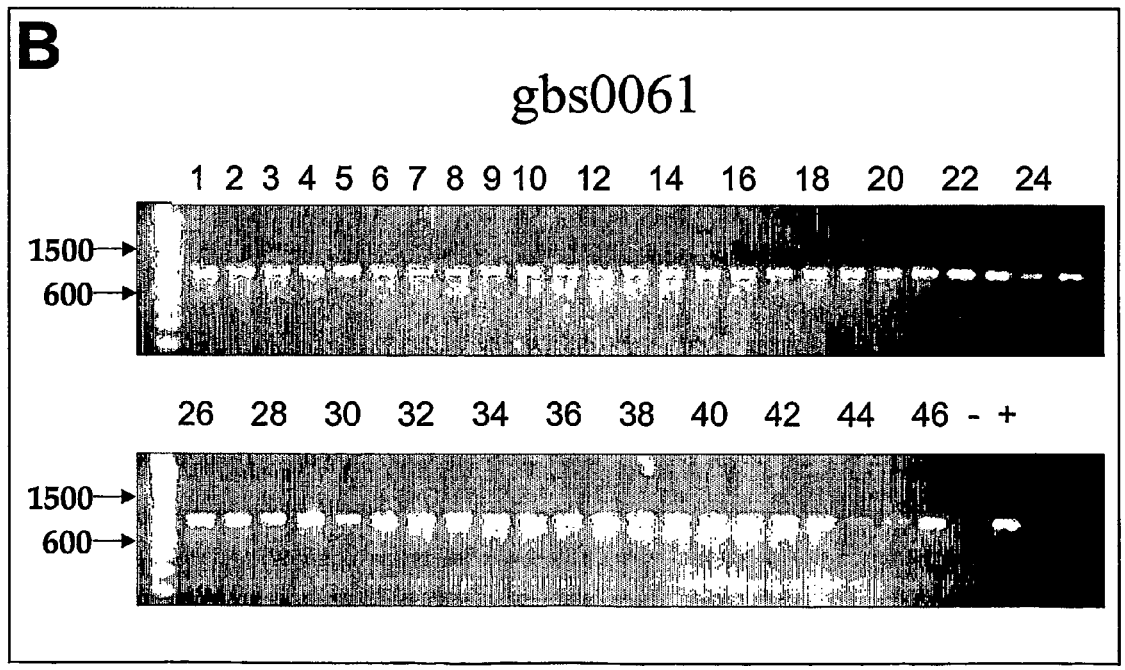

FIG. 4(A) shows the representation of different serotypes of S. agalactiae clinical isolates analyzed for the gene distribution study. A number of the strains were not typeable and may represent additional serotypes. (B) shows the PCR analysis for the gene distribution of gbs0061 with the respective oligonucleotides and 46 S. agalactiae strains. The predicted size of the PCR fragments is 814 bp. 1-46, S. agalactiae strains, clinical isolates as shown under A; −, no genomic DNA added; +, genomic DNA from S. agalactiae ATCC 12403, which served as template for library construction.

Figure 5:
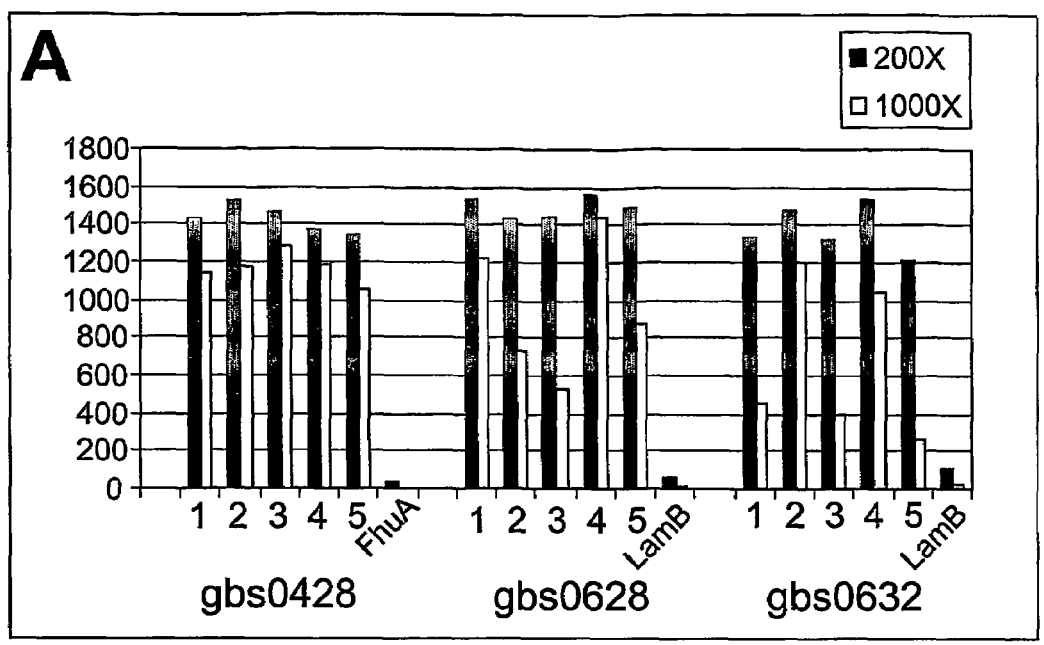
FIG. 5 shows examples for induction of epitope-specific antibodies in mice by immunization with E. coli lysates.
Figure 5:
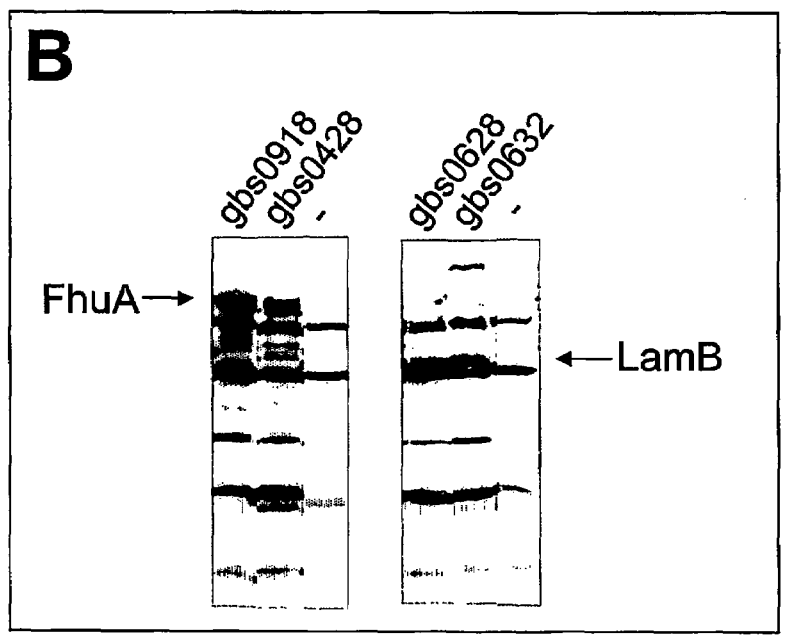

FIG. 5 shows the measurement of epitope-specific mouse serum IgG antibody levels induced by total bacterial lysates of Lamb or FhuA expressing E. coli clones with S. agalactiae-derived epitopes. (A) shows representative peptide ELISA experiments with three sets of mouse sera (5 mice in each group, 1-5) generated by gbs0428, gbs0628 and gbs632 epitopes, respectively. Sera were tested at two different dilutions: black bars: 100×; grey bars; 1000×. Biotin-labeled synthetic peptides corresponding to the respective epitopes were used in the peptide ELISA. Sera induced with E. coli lysate without S. agalactiae derived epitopes are indicated as FhuA or LamB. (B) shows a typical immunoblotting experiment using lysates prepared from individual E. coli clones selected for mouse injections. Sera were depleted by E. coli lysate not carrying epitope to remove antibodies against E. coli proteins. Examples are shown for gbs0918, gbs0428, gbs0628 and gbs632 epitopes. Negative controls (−) are E. coli clones with empty platform proteins. Location of platform proteins LamB and FhuA is indicated by arrows.

Figure 6:
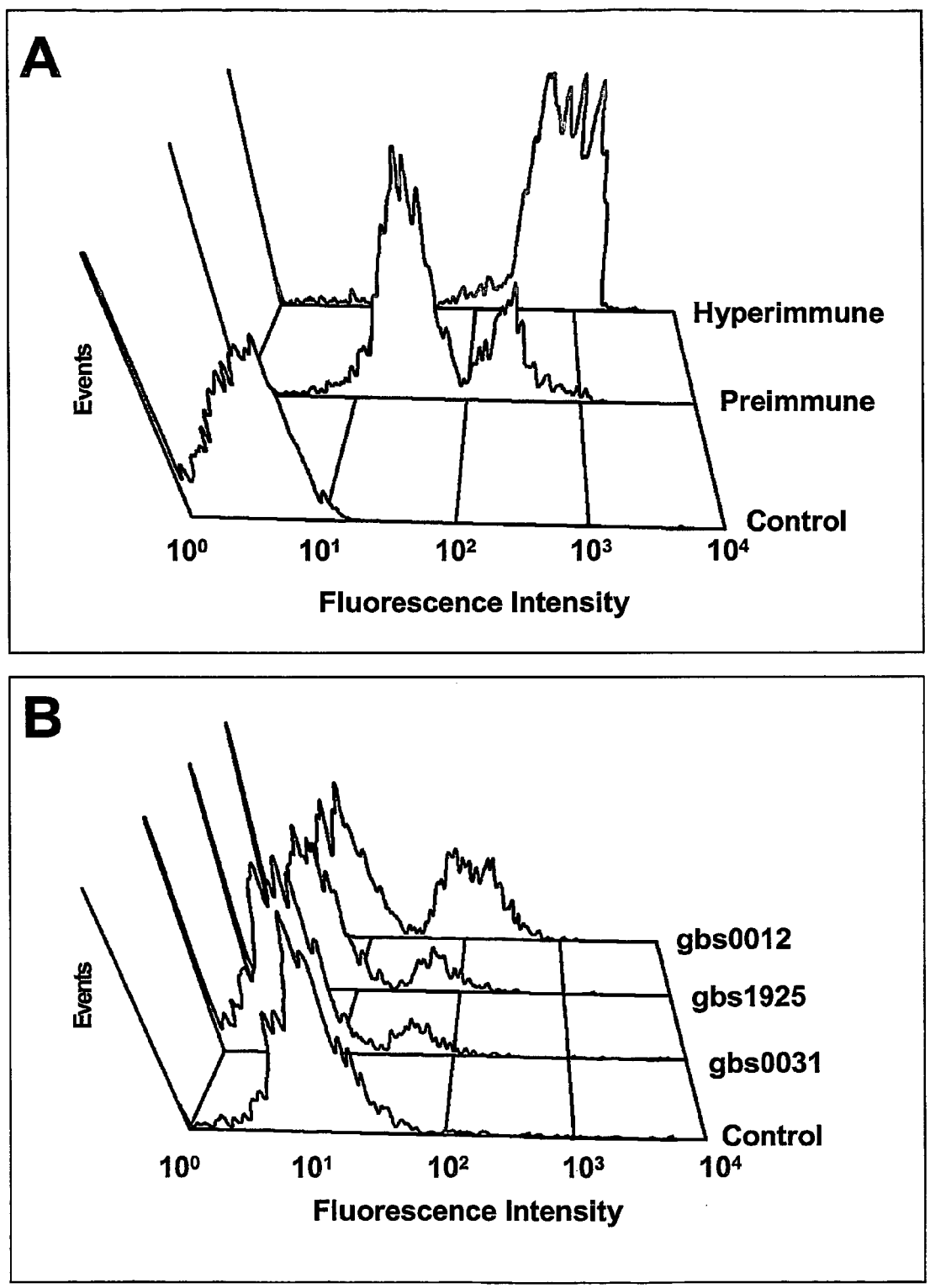
FIG. 6 shows examples for cell surface staining with epitope-specific antisera by flow cytometry.

FIG. 6 shows the detection of specific antibody binding on the cell surface of Streptococcus agalactiae by flow cytometry. In FIG. 6A preimmune mouse sera and polyclonal sera raised against S. agalactiae serotype III lysate were incubated with S. agalactiae strain serotype III and analyzed by flow cytometry. Control shows the level of non-specific binding of the secondary antibody to the surface of S. agalactiae cells. The histograms in FIG. 6B indicates the increased fluorescence due to specific binding of anti-gbs0031, anti-gbs1925 and anti-gbs0012 antibodies in comparison to the control sera generated against E. coli lysate containing only the 'empty' platform protein FhuA.

Figure 7:
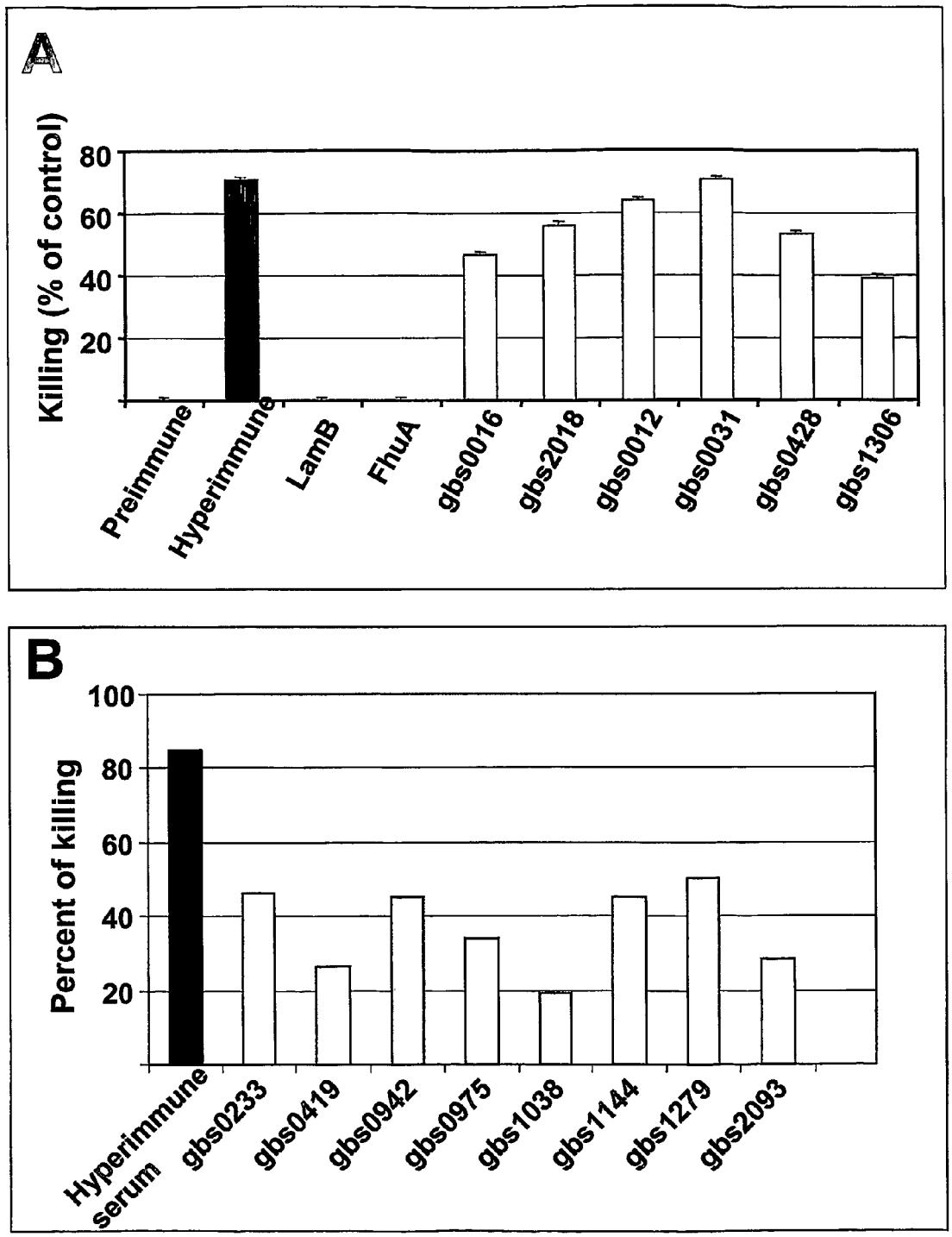
FIG. 7 shows the determination of bactericidal activity of antibodies induced by selected epitopes in an in vitro assay.

FIG. 7 shows the bactericidal activity of epitope specific antibodies as determined in in vitro killing assay. The killing activity of immune sera is measured parallel with and calculated relative to the appropriate control sera. Data are expressed as percentage of killing, that is the reduction on bacterial cfu numbers as a consequence of the presence of specific antibodies. Hyperimmune polyclonal mouse sera generated with S. agalactiae lysate and sera from non-immunized mice served as positive and negative controls for the assay, respectively. Immune sera generated with (A) gbs0012, gbs0016, gbs0031, gbs0428, gbs1306 and gbs2018 epitopes and with (B) gbs0233, gbs0419, gbs0942, gbs0975, gbs1038, gbs1144 and gbs2093 epitopes were tested for bactericidal activity and data are expressed relative to appropriate controls, such as sera induced with Lamb or FhuA expressing E. coli clones without S. agalactiae-derived epitopes. S. agalactiae serotype III cells were incubated with mouse phagocytic cells for 60 min, and surviving bacteria were quantified by counting cfus after plating on blood agar.

Table 1: Immunogenic Proteins Identified by Bacterial Surface Display.

(A) Columns A, 300 bp library of S. agalactiae ATCC 12403 in fhuA with NSag8-IgA (826), B, 300 bp library in fhuA with PSag10-IgA (768), C, 300 bp library in fhuA with PSag10-IgG (711), D, 300 bp library in fhuA with PSag11-IgG (640), E, 70 bp library in lamB with NSag8-IgA (1057), F, 70 bp library in lamB with NSag8-IgG (869), G, 70 bp library in lamB with PSag10-IgA (904), H, 70 bp library in lamB with PSag10-IgA-adsorbed (493), I, 70 bp library in lamB with PSag10-IgG (910), J, 70 bp library in lamB with PSag11-IgA (631), K, 70 bp library in lamB with PSag11-IgG (926), L, 70 bp library in lamB with PSag18-IgA (691), M, 70 bp library in lamB with PSag-sIgA (628); *, prediction of antigenic sequences longer than 5 amino acids was performed with the program ANTIGENIC (Kolaskar and Tongaonkar, 1990). Table 1B lists the immunogenic proteins identified by amino acid sequence identity with peptides identified by bacterial surface display. Antigenic peptides, which have been identified by bacterial surface-display possess identical counterparts in the listed proteins from S. agalactiae. The peptides have been shown to react with multiple human sera (see Table 2). Sera directed against these peptides can therefore recognize multiple proteins.

Table 2: Epitope Serology with Human Sera.

Immune reactivity of individual synthetic peptides representing selected epitopes with human sera is shown. Extent of reactivity is expressed as +, ++ or +++, and summed from individual reactivities of peptides with individual sera (13 patient and 9 healthy adult, 22 total). A total score for each peptide was calculated based on ELISA units as the sum of all reactivities. Scores were 2-8 for +, 9-16 for ++ and 17-26 for +++. ELISA units were calculated from $OD_{405\ nm}$ readings and the serum dilution after correction for background. Location of synthetic peptides within the antigenic ORFs according to the genome annotation of ATCC 12403 strain is given in columns aa from and aa to indicating the first and last amino acid residues, respectively. Peptide names: gbs0012.1 present in annotated ORF: gbs0012.

Table 3: Gene distribution in S. agalactiae Strains.

Forty-six S. agalactiae strains as shown in FIG. 4A were tested by PCR with oligonucleotides specific for the genes encoding relevant antigens. The PCR fragment of one selected PCR reaction was sequenced in order to confirm the amplification of the correct DNA fragment. *, number of amino acid substitutions in a serotype IA strain as derived from sequencing as compared to *S. agalactiae* ATCC 12403. #, alternative strain used for sequencing, because gene was not present in the serotype IA strain.

Table 4: Immunogenicity of Antigenic Epitopes.

*S. agalactiae* antigens were tested for immunogenicity by immunization with *E. coli* clones harboring plasmids encoding the platform proteins LamB or FhuA fused to *S. agalactiae* peptides. The presence of epitope-specific antibodies were detected and measured by peptide ELISA and/or immunoblotting using the corresponding *E. coli* clone lysate, which served as immunogen. Results are expressed as + to ++++, and calculated for peptide ELISA as the sum of the reactivity of individual mouse sera based on ELISA units (as indicated on FIG. 5A) and for immunoblotting (IB) as the strength of reactivity of pooled (5 individual) mouse sera with the epitope containing platform protein (as indicated on FIG. 5B). Location of synthetic peptides within the antigenic ORFs according to the genome annotation of ATCC 12403 strain is given in columns aa from and aa to indicating the first and last amino acid residues, respectively.

Table 5: Immunogenic Proteins Identified by Bacterial Surface Display.

(A) 300 bp library of *S. agalactiae* ATCC 12403 in fhuA with IC8-IgA (826), B, 300 bp library in fhuA with P10-IgA (768), C, 300 bp library in fhuA with P10-IgG (711), D, 300 bp library in fhuA with P11-IgG (640), E, 70 bp library in lamB with IC8-IgA (1057), F, 70 bp library in lamB with IC8-IgG (869), G, 70bp library in lamB with P10-IgA (904), H, 70 bp library in lamB with P10-IgA-adsorbed (493), I, 70 bp library in lamB with P10-IgG (910), J, 70 bp library in lamB with P11-IgA (631), K, 70 bp library in lamB with P11-IgG (926), *, prediction of antigenic sequences longer than 5 amino acids was performed with the program ANTIGENIC (Kolaskar and Tongaonkar, 1990).

Table 6: Epitope Eerology with Human Sera.

Immune reactivity of individual synthetic peptides representing selected epitopes with human sera is shown. Extent of reactivity is expressed as +, ++ or +++, and summed from individual reactivities of peptides with individual sera (13 patient and 9 healthy adult, 22 total). A total score for each peptide was calculated based on ELISA units as the sum of all reactivities. Scores were 2-8 for +, 9-16 for ++ and 17-30 for +++. ELISA units were calculated from $OD_{405\ nm}$ readings and the serum dilution after correction for background. Location of synthetic peptides within the antigenic ORFs according to the genome annotation of ATCC 12403 strain is given in columns aa from and aa to indicating the first and last amino acid residues, respectively. Peptide names: gbs0233.1 present in annotated ORF: gbs0233.

Table 7: Immunogenicity of Antigenic Epitopes in Mice.

*S. agalactiae* antigens were tested for immunogenicity by immunization with *E. coli* clones harboring plasmids encoding the platform proteins LamB or FhuA fused to *S. agalactiae* peptides. The presence of epitope-specific antibodies were detected and measured by peptide ELISA. Results are expressed as + to +++++, and calculated for peptide ELISA as the sum of the reactivity of individual mouse sera based on ELISA units (as indicated on FIG. 5). Location of epitopes within the antigenic ORFs according to the genome annotation of ATCC 12403 strain is given in columns aa from and aa to indicating the first and last amino acid residues, respectively.

EXAMPLES

Example 1

Characterization and Selection of human Serum Sources Based on Anti-*S. agalactiae* Antibodies, Preparation of Antibody Screening Reagents Experimental Procedures Enzyme Linked Immune Assay (ELISA).

ELISA plates (Maxisorb, Millipore) were coated with 5-10 µg/ml total protein diluted in coating buffer (0.1M sodium carbonate pH 9.2). Three dilutions of sera (2,000×, 10,000×, 50,000×) were made in PBS-BSA. Highly specific Horse Radish Peroxidase (HRP)-conjugated anti-human IgG or anti-human IgA secondary antibodies (Southern Biotech) were used according to the manufacturers' recommendations (dilution: 1,000×). Antigen-antibody complexes were quantified by measuring the conversion of the substrate (ABTS) to colored product based on $OD_{405\ nm}$ readings by automatic ELIAS reader (TECAN SUNRISE).

Preparation of Bacterial Antigen Extracts

Total bacterial lysate: Bacteria were grown overnight in THB (Todd-Hewitt Broth) and lysed by repeated freeze-thaw cycles: incubation on dry ice/ethanol-mixture until frozen (1 min), then thawed at 37°0 C. (5 min): repeated 3 times. This was followed by sonication and collection of supernatant by centrifugation (3,500 rpm, 15 min, 4°0 C.).

Culture supernatant: After removal of bacteria by centrifugation, the supernatant of overnight grown bacterial cultures was precipitated with ice-cold ethanol by mixing 1 part supernatant with 3 parts absolute ethanol and incubated overnight at −20° C. Precipitates were collected by centrifugation (2,600 g, for 15 min). Dry pellets were dissolved either in PBS for ELISA, or in urea and SDS-sample buffer for SDS-PAGE and immunoblotting. The protein concentration of samples was determined by Bradford assay.

Immunoblotting

Total bacterial lysate and culture supernatant samples were prepared from in vitro grown *S. agalactiae* serotype III strain. 10 to 25 µg total protein/lane was separated by SDS-PAGE using the BioRad Mini-Protean Cell electrophoresis system and proteins transferred to nitrocellulose membrane (ECL, Amersham Pharmacia). After overnight blocking in 5% milk, human sera were added at 2,000× dilution, and HRPO labeled anti-human IgG was used for detection.

Extraction of Antibodies From Cervical Wicks

Cervical secretions were collected by absorbent cylindrical wicks (Polyfiltronics) which were introduced into the cervical canal during speculum examination and thereafter kept frozen until extraction. Extraction was done according to Hordnes et al, 1998 (provider of the samples). Briefly, wicks were mixed with PBS containing protease inhibitors, vortexed and fluid was drained from the tubes containing the wicks. The concentrations of total IgA and IgG antibodies in extracts were determined.

Purification of antibodies for genomic screening. Five sera from both the patient and the healthy group were selected based on the overall anti-GBS titers for serum or cervical secretion pools used in the screening procedure. Antibodies against *E. coli* proteins were removed by incubating the heat-inactivated sera with whole cell *E. coli* cells (DH5alpha, transformed with pHIE11, grown under the same condition as used for bacterial surface display). Highly enriched preparations of IgGs from the pooled, depleted sera were generated by protein G affinity chromatography, according to the manufacturer's instructions (UltraLink Immobilized Protein G, Pierce). IgA antibodies were purified also by affinity chromatography using biotin-labeled anti-human IgA (Southern Biotech) immobilized on Streptavidin-agarose (GIBCO BRL). The efficiency of depletion and purification was checked by SDS-PAGE, Western blotting, ELISA and protein concentration measurements.

Results

The antibodies produced against S. agalactiae by the human immune system and present in human sera are indicative of the in vivo expression of the antigenic proteins and their immunogenicity. These molecules are essential for the identification of individual antigens in the approach as described in the present invention, which is based on the interaction of the specific anti-GBS antibodies and the corresponding S. agalactiae peptides or proteins. To gain access to relevant antibody repertoires, human sera were collected from I. healthy pregnant women tested negative for cervical and anorectal carriage of GBS
II. healthy pregnant women tested positive for cervical and/or anorectal carriage of GBS who's newborn remained GBS-free (although with antibiotic prevention).
III. adults below <45 years of age without clinical disease.
IV. naïve individuals, young children between 5 and 10 months of age, after they already lost maternal antibodies and have not acquired GBS-specific ones due to the lack of GBS disease.

In addition cervical secretions were also collected from the first two groups of donors. The extreme value of these antibody sources is mainly the secretory IgA component, which is directly implicated as protective effector molecule on mucosal surfaces.

It is important to screen with antibodies from at least two different populations, pregnant women and nonpregnant adults, since GBS disease affects elderly and immunocompromised adults, as well. Within the pregnant study group, there are again two different patient categories, women who are GBS colonized and those who are noncolonized, to be included in the antigen screen.

Antibodies in serum and other body fluids, such as mucosal secretions induced in individuals exposed to the pathogens are crucial for antigen identification. The exposure to GBS results in asymptomatic colonization, current or past acute or chronic infection. S. agalactiae colonization and infections are common, and antibodies are present as a consequence of natural immunization from previous encounters. It is likely that sera from high titer noncolonized individuals contain functional antibodies, which are able to eliminate carriage. At the same time certain antibodies might be induced against GBS components only if the antigen persist. For that reason sera from colonized individuals were also included. It has been shown that colonization is associated with capsular polysaccharide (CPS)-specific antibody responses. However, it is not clear whether sufficient level of antibodies to CPS's would prevent GBS colonization, since there are colonized women with both high and low levels of anti-CPS antibody, and the same is true for noncolonized pregnant women.

However, there are reports that effector function and avidity of antibodies produced during pregnancy might be altered. It is important to recognize that most healthy adults are protected from invasive GBS disease and are less susceptible than newborns and the elderly. Antibodies from these individuals seem to be especially valuable for identification of the corresponding antigens. It is known that anti-GBS antibody levels increase with age.

GBS is a mucosal pathogen and should induce IgA response; for that reason it was important to perform IgA-based screens, as well as IgG-based screens. The fact that some S. agalactiae strains express high affinity IgA-binding receptor also points to the importance of IgA in host response. Recently it was reported that not only IgG, but also IgA serum antibodies can be recognized by the FcRIII receptors of PMNs and promote opsonization {Phillips-Quagliata, J. et al., 2000}; {Shibuya, A. et al., 2000}. The primary role of IgA antibodies is neutralization, mainly at the mucosal surface. The level of serum IgA reflects the quality, quantity and specificity of the dimeric secretory IgA. For that reason the serum collection was not only analyzed for anti-streptococcal IgG, but also for IgA levels. In the ELISA assays highly specific secondary reagents were used to detect antibodies from the high affinity types, such as IgG and IgA, but avoided IgM. Production of IgM antibodies occurs during the primary adaptive humoral response, and results in low affinity antibodies, while IgG and IgA antibodies had already undergone affinity maturation, and are more valuable in fighting or preventing disease.

127 serum samples and 97 cervical secretions from pregnant women and 50 sera from healthy adults were characterized for anti-S. agalactiae antibodies by a series of immune assays. Primary characterization was done by ELISA using two different antigen preparations, such as total bacterial extract and culture supernatant proteins prepared from S. agalactiae serotype III ATCC 12403 strain. A representative experiment is shown in FIG. 1A using sera from the healthy adult population. Antibody titers were compared at given dilutions where the response was linear. Sera were ranked based on the IgG and IgA reactivity against the two complex antigenic mixtures (including serotype specific type III capsule), and the highest ones were selected for further testing by immunoblotting. This analysis confirmed a high antibody reactivity of the pre-selected sera against multiple GBS proteins, especially when compared to not selected, low-titer sera (FIG. 1B). However, ELISA ranking of sera did not always correlated with immunoblot signals suggesting that anti-capsular antibodies were abundant and dominated the ELISA reactivities against total bacterial extracts. Thus the final selection of sera to be included in antibody-pools was based mainly on multiple immunogenic bands in immunoblotting experiments. This extensive antibody characterization approach has led to the unambiguous identification of anti-GBS hyperimmune sera.

The 97 cervical secretions were determined for IgA content, and same amount (2 µg) was tested for anti-GBS reactivity by immunoblotting. Positively selected sera (as it is shown in FIG. 1C) were divided into colonized and noncolonized IgA pools and used separately in bacterial surface display experiments.

5 sera from both donor groups were selected and pooled for antigen identification by bacterial surface display. Selected sera included in the four pregnant women pools (PSAg10-IgG,-IgA, PSAg11-IgG, PSAg18-IgG and PSAg-sIgA) and one healthy adult (non-pregnant) pool (NSAg8-IgG,-IgA). IgG and IgA antibodies were purified from pooled sera by affinity chromatography and depleted of E. coli-reactive antibodies to avoid background in the bacterial surface display screen.

Example 2

Generation of Highly Random, Frame-selected, Small-fragment, Genomic DNA Libraries of *Streptococcus agalactiae*

Experimental Procedures

Preparation of streptococcal genomic DNA. 50 ml Todd-Hewitt Broth medium was inoculated with *S. agalactiae* ATCC 12403 bacteria from a frozen stab and grown with aeration and shaking for 18 h at 37° C. The culture was then harvested, centrifuged with 1,600×g for 15 min and the supernatant was removed. Bacterial pellets were washed 3× with PBS and carefully re-suspended in 0.5 ml of Lysozyme solution (100 mg/ml). 0.1 ml of 10 mg/ml heat treated RNase A and 20 U of RNase T1 were added, mixed carefully and the solution was incubated for 1 h at 37° C. Following the addition of 0.2 ml of 20% SDS solution and 0.1 ml of Proteinase K (10 mg/ml) the tube was incubated overnight at 55° C. ⅓ volume of saturated NaCl was then added and the solution was incubated for 20 min at 4° C. The extract was pelleted in a microfuge (13,000 rpm) and the supernatant transferred into a new tube. The solution was extracted with PhOH/CHCl$_3$/IAA (25:24:1) and with CHCl$_3$/IAA (24:1). DNA was precipitated at room temperature by adding 0.6× volume of Isopropanol, spooled from the solution with a sterile Pasteur pipette and transferred into tubes containing 80% ice-cold ethanol. DNA was recovered by centrifuging the precipitates with 10-12,000×g, then dried on air and dissolved in ddH$_2$O.

Preparation of small genomic DNA fragments. Genomic DNA fragments were mechanically sheared into fragments ranging in size between 150 and 300 bp using a cup-horn sonicator (Bandelin Sonoplus UV 2200 sonicator equipped with a BB5 cup horn; 10 sec. pulses at 100% power output) or into fragments of size between 50 and 70 bp by mild DNase I treatment (Novagen). It was observed that sonication yielded a much tighter fragment size distribution when breaking the DNA into fragments of the 150-300 bp size range. However, despite extensive exposure of the DNA to ultrasonic wave-induced hydromechanical shearing force, subsequent decrease in fragment size could not be efficiently and reproducibly achieved. Therefore, fragments of 50 to 70 bp in size were obtained by mild DNase I treatment using Novagen's shotgun cleavage kit. A 1:20 dilution of DNase I provided with the kit was prepared and the digestion was performed in the presence of MnCl$_2$ in a 60 μl volume at 20° C. for 5 min to ensure double-stranded cleavage by the enzyme. Reactions were stopped with 2 μl of 0.5 M EDTA and the fragmentation efficiency was evaluated on a 2% TAE-agarose gel. This treatment resulted in total fragmentation of genomic DNA into near 50-70 bp fragments. Fragments were then blunt-ended twice using T4 DNA Polymerase in the presence of 100 μM each of dNTPs to ensure efficient flushing of the ends. Fragments were used immediately in ligation reactions or frozen at −20° C. for subsequent use.

Description of the vectors. The vector pMAL4.31 was constructed on a pASK-IBA backbone {Skerra, A., 1994} with the beta-lactamase (bla) gene exchanged with the Kanamycin resistance gene. In addition the bla gene was cloned into the multiple cloning site. The sequence encoding mature beta-lactamase is preceded by the leader peptide sequence of ompA to allow efficient secretion across the cytoplasmic membrane. Furthermore a sequence encoding the first 12 amino acids (spacer sequence) of mature beta-lactamase follows the ompA leader peptide sequence to avoid fusion of sequences immediately after the leader peptidase cleavage site, since e.g. clusters of positive charged amino acids in this region would decrease or abolish translocation across the cytoplasmic membrane {Kajava, A. et al., 2000}. A SmaI restriction site serves for library insertion. An upstream FseI site and a downstream NotI site, which were used for recovery of the selected fragment, flank the SmaI site. The three restriction sites are inserted after the sequence encoding the 12 amino acid spacer sequence in such a way that the bla gene is transcribed in the −1 reading frame resulting in a stop codon 15 bp after the NotI site. A +1 bp insertion restores the bla ORF so that beta-lactamase protein is produced with a consequent gain of Ampicillin resistance.

The vector pMAL9.1 was constructed by cloning the lamB gene into the multiple cloning site of pEH1 {Hashemzadeh-Bonehi, L. et al., 1998}. Subsequently, a sequence was inserted in lamB after amino acid 154, containing the restriction sites FseI, SmaI and NotI. The reading frame for this insertion was constructed in such a way that transfer of frame-selected DNA fragments excised by digestion with FseI and NotI from plasmid pMAL4.31 yields a continuous reading frame of lamB and the respective insert.

The vector pHIE11 was constructed by cloning the fhuA gene into the multiple cloning site of pEH1. Thereafter, a sequence was inserted in fhuA after amino acid 405, containing the restriction site FseI, XbaI and NotI. The reading frame for this insertion was chosen in a way that transfer of frame-selected DNA fragments excised by digestion with FseI and NotI from plasmid pMAL4.31 yields a continuous reading frame of fhuA and the respective insert.

Cloning and evaluation of the library for frame selection. Genomic *S. agalactiae* DNA fragments were ligated into the SmaI site of the vector pMAL4.31. Recombinant DNA was electroporated into DH10B electrocompetent *E. coli* cells (GIBCO BRL) and transformants plated on LB-agar supplemented with Kanamycin (50 μg/ml) and Ampicillin (50 μg/ml). Plates were incubated over night at 37° C. and colonies collected for large scale DNA extraction. A representative plate was stored and saved for collecting colonies for colony PCR analysis and large-scale sequencing. A simple colony PCR assay was used to initially determine the rough fragment size distribution as well as insertion efficiency. From sequencing data the precise fragment size was evaluated, junction intactness at the insertion site as well as the frame selection accuracy (3n+1 rule).

Cloning and evaluation of the library for bacterial surface display. Genomic DNA fragments were excised from the pMAL4.31 vector, containing the *S. agalactiae* library with the restriction enzymes FseI and NotI. The entire population of fragments was then transferred into plasmids pMAL9.1 (LamB) or pHIE11 (FhuA), which have been digested with FseI and NotI. Using these two restriction enzymes, which recognise an 8 bp GC rich sequence, the reading frame that was selected in the pMAL4.31 vector is maintained in each of the platform vectors. The plasmid library was then transformed into *E. coli* DH5alpha cells by electroporation. Cells were plated onto large LB-agar plates supplemented with 50 μg/ml Kanamycin and grown over night at 37° C. at a density yielding clearly visible single colonies. Cells were then scraped off the surface of these plates, washed with fresh LB medium and stored in aliquots for library screening at −80° C.

Results

Figure 2:
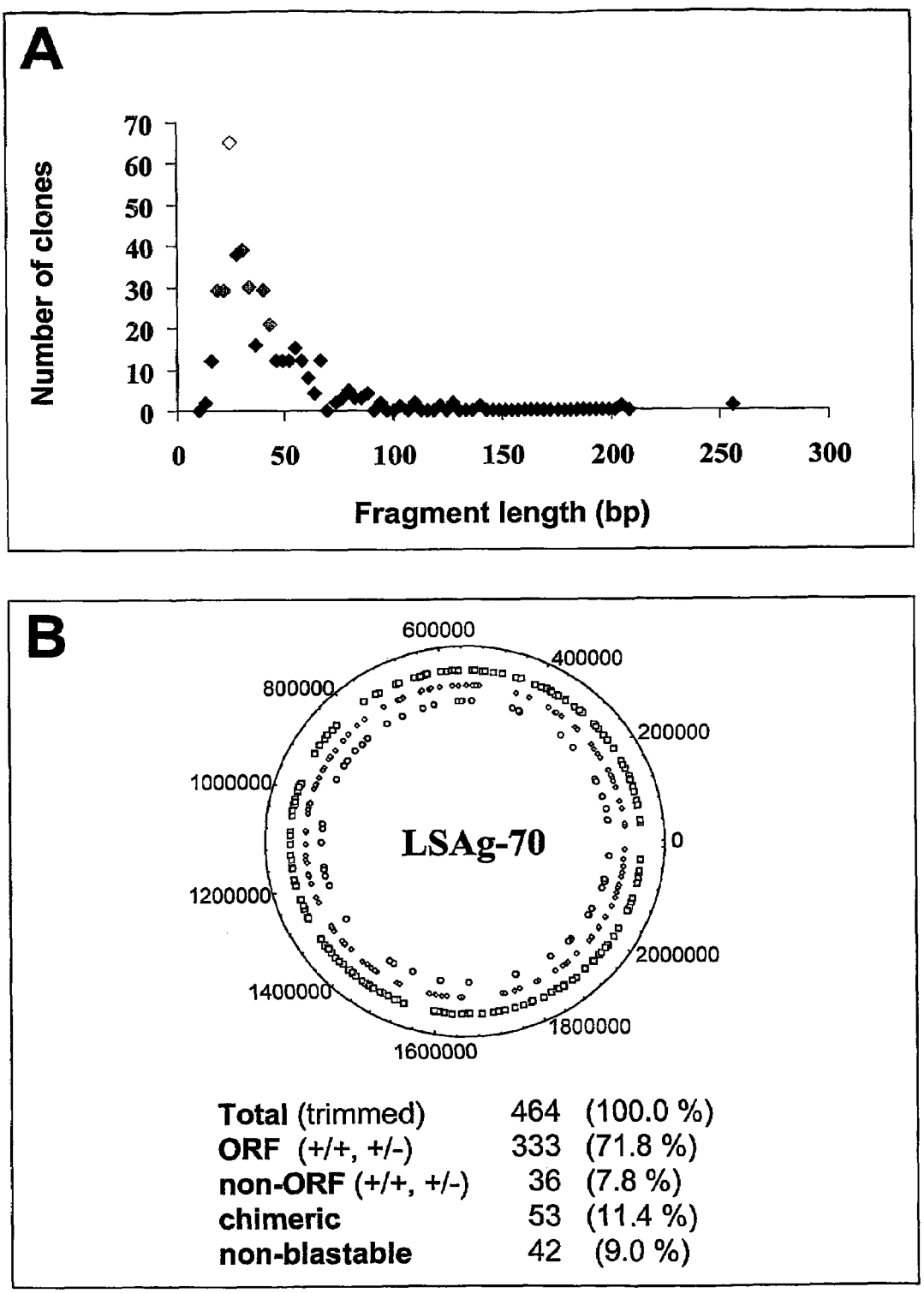
FIG. 2 shows the characterization of the small fragment genomic library, LSAg-70, from Streptococcus agalactiae ATCC 12403.

Libraries for frame selection. Two libraries (LSAg-70 and LSAg-300) were generated in the pMAL4.31 vector with sizes of approximately 70 and 300 bp, respectively. For each library, ligation and subsequent transformation of approximately 1 μg of pMAL4.31 plasmid DNA and 50 ng of fragmented genomic S. agalactiae DNA yielded $4\times10^5$ to $2\times10^6$ clones after frame selection. To assess the randomness of the libraries, approximately 576 randomly chosen clones of LSAg-70 were sequenced. The bioinformatic analysis showed that of these clones only very few were present more than once. Furthermore, it was shown that approximately 80% of the clones fell in the size range between 25 and 100 bp with an average size of approximately 40 bp (FIG. 2). Almost all sequences followed the 3n+1 rule, showing that all clones were properly frame selected.

Bacterial surface display libraries. The display of peptides on the surface of E. coli required the transfer of the inserts from the LSAg-70 and LSAg-300 libraries from the frame selection vector pMAL4.31 to the display plasmids pMAL9.1 (LamB) or pHIE11 (FhuA). Genomic DNA fragments were excised by FseI and NotI restriction and ligation of 5 ng inserts with 0.1 µg plasmid DNA and subsequent transformation into DH5alpha cells resulted in $2$-$5\times10^6$ clones. The clones were scraped off the LB plates and frozen without further amplification.

Example 3

Identification of Highly Immunogenic Peptide Sequences from S. agalactiae Using Bacterial Surface Displayed Genomic Libraries and Human Serum Experimental Procedures MACS screening. Approximately $2.5\times10^8$ cells from a given library were grown in 5 ml LB-medium supplemented with 50 µg/ml Kanamycin for 2 h at 37° C. Expression was induced by the addition of 1 mM IPTG for 30 min. Cells were washed twice with fresh LB medium and approximately $2\times10^7$ cells re-suspended in 100 µl LB medium and transferred to an Eppendorf tube.

10 to 20 µg of biotinylated, human IgGs purified from serum was added to the cells and the suspension incubated overnight at 4° C. with gentle shaking. 900 µl of LB medium was added, the suspension mixed and subsequently centrifuged for 10 min at 6,000 rpm at 4° C. (For IgA screens, 10 µg of purified IgAs were used and these captured with biotinylated anti-human-IgG secondary antibodies). Cells were washed once with 1 ml LB and then re-suspended in 100 µl LB medium. 10 µl of MACS microbeads coupled to streptavidin (Miltenyi Biotech, Germany) were added and the incubation continued for 20 min at 4° C. Thereafter 900 µl of LB medium was added and the MACS microbead cell suspension was loaded onto the equilibrated MS column (Miltenyi Biotech, Germany) which was fixed to the magnet. (The MS columns were equilibrated by washing once with 1 ml 70% EtOH and twice with 2 ml LB medium.)

The column was then washed three times with 3 ml LB medium. After removal of the magnet, cells were eluted by washing with 2 ml LB medium. After washing the column with 3 ml LB medium, the 2 ml eluate was loaded a second time on the same column and the washing and elution process repeated. The loading, washing and elution process was performed a third time, resulting in a final eluate of 2 ml.

A second and third round of screening was performed as follows. The cells from the final eluate were collected by centrifugation and re-suspended in 1 ml LB medium supplemented with 50 µg/ml Kanamycin. The culture was incubated at 37° C. for 90 min and then induced with 1 mM IPTG for 30 min. Cells were subsequently collected, washed once with 1 ml LB medium and suspended in 10 µl LB medium. 10 to 20 µg of human, biotinylated IgGs were added again and the suspension incubated over night at 4° C. with gentle shaking. All further steps were exactly the same as in the first selection round. Cells selected after two rounds of selection were plated onto LB-agar plates supplemented with 50 µg/ml Kanamycin and grown over night at 37° C.

Evaluation of selected clones by sequencing and Western blot analysis. Selected clones were grown overnight at 37° C. in 3 ml LB medium supplemented with 50 µg/ml Kanamycin to prepare plasmid DNA using standard procedures. Sequencing was performed at MWG (Germany) or in collaboration with TIGR (U.S.A.).

For Western blot analysis approximately 10 to 20 µg of total cellular protein was separated by 10% SDS-PAGE and blotted onto HybondC membrane (Amersham Pharmacia Biotech, England). The LamB or FhuA fusion proteins were detected using human serum as the primary antibody at a dilution of approximately 1:3,000 to 1:5,000 and anti-human IgG or IgA antibodies coupled to HRP at a dilution of 1:5,000 as secondary antibodies. Detection was performed using the ECL detection kit (Amersham Pharmacia Biotech, England). Alternatively, rabbit anti-FhuA or rabbit anti-LamB polyclonal immune sera were used as primary antibodies in combination with the respective secondary antibodies coupled to HRP for the detection of the fusion proteins.

Results

Screening of bacterial surface display libraries by magnetic activated cell sorting (MACS) using biotinylated Igs. The libraries LSag-70 in pMAL9.1 and LSag-300 in pHIE11 were screened with pools of biotinylated, human IgGs and IgAs prepared from sera of healthy adults (NSag8-IgG,-IgA) or P10,11,18 (see Example 1: Preparation of antibodies from human serum). The selection procedure was performed as described under Experimental procedures. FIG. 3A shows a representative example of a screen with the LSag-70 library and PSag11-IgGs. As can be seen from the colony count after the first selection cycle from MACS screening, the total number of cells recovered at the end is drastically reduced from $2\times10^7$ cells to approximately $2\times10^4$ cells, but the selection without antibodies added showed a similar reduction in cell numbers (FIG. 3A). Therefore a second and third round of selection was performed. At the end of round three, approximately $10^4$ cells was recovered with PSag11-IgGs, while only $2\times10^3$ cells were recovered when no IgGs from human serum were added, clearly showing that selection was dependent on S. agalactiae specific antibodies. To evaluate the performance of the screen, 26 selected clones were picked randomly and subjected to immunoblot analysis with screening IgG pool (FIG. 3B). This analysis revealed that more than 80% of the selected clones showed reactivity with antibodies present in the relevant serum whereas the control strain expressing LamB without a S. agalactiae specific insert did not react with the same serum. In general, the rate of reactivity was observed to lie within the range of 35 to 90%. Colony PCR analysis showed that all selected clones contained an insert in the expected size range.

Subsequent sequencing of a larger number of randomly picked clones (600 to 1200 per screen) led to the identification of the gene and the corresponding peptide or protein sequence that was specifically recognized by the human serum antibodies used for screening. The frequency with which a specific clone is selected reflects at least in part the abundance and/or affinity of the specific antibodies in the serum used for selection and recognizing the epitope presented by this clone. In that regard it is striking that clones derived from some ORFs (e.g. gbs1087, gbs1306, gbs2018) were picked more than 100 times, indicating their highly immunogenic property. Table 1 and Table 5 summarizes the data obtained for all 13 performed screens. All clones that are presented in Table 1 and Table 5 have been verified by immunoblot analysis using whole cellular extracts from single clones to show the indicated reactivity with the pool of human serum used in the respective screen. As can be seen from Table 1 and Table 5, distinct regions of the identified ORF are identified as immunogenic, since variably sized fragments of the proteins are displayed on the surface by the platform proteins.

It is further worth noticing that most of the genes identified by the bacterial surface display screen encode proteins that are either attached to the surface of S. agalactiae and/or are secreted. This is in accordance with the expected role of surface attached or secreted proteins in virulence of S. agalactiae.

Example 4

Assessment of the Reactivity of Highly Immunogenic Peptide Sequences with Individual Human Sera.

Experimental Procedures

Peptide Synthesis

Peptides were synthesized in small scale (4 mg resin; up to 288 in parallel) using standard F-moc chemistry on a Rink amide resin (PepChem, Tübingen, Germany) using a SyroII synthesizer (Multisyntech, Witten, Germany). After the sequence was assembled, peptides were elongated with Fmoc-epsilon-aminohexanoic acid (as a linker) and biotin (Sigma, St. Louis, Mo.; activated like a normal amino acid). Peptides were cleaved off the resin with 93% TFA, 5% triethylsilane, and 2% water for one hour. Peptides were dried under vacuum and freeze dried three times from acetonitrile/water (1:1). The presence of the correct mass was verified by mass spectrometry on a Reflex III MALDI-TOF (Bruker, Bremen Germany). The peptides were used without further purification.

Enzyme Linked Immune Assay (ELISA).

Biotin-labeled peptides (at the N-terminus) were coated on Streptavidin ELISA plates (EXICON) at 10 µg/ml concentration according to the manufacturer's instructions. Highly specific Horse Radish Peroxidase (HRP)-conjugated anti-human IgG secondary antibodies (Southern Biotech) were used according to the manufacturers' recommendations (dilution: 1,000×). Sera were tested at two serum dilutions, 200× and 1,000×. Following manual coating, peptide plates were processed and analyzed by the Gemini 160 ELISA robot (TECAN) with a built-in ELISA reader (GENIOS, TECAN).

Results

Following the bioinformatic analysis of selected clones, corresponding peptides were designed and synthesized. In case of epitopes with more than 26 amino acid residues, overlapping peptides were made. All peptides were synthesized with a N-terminal biotin-tag and used as coating reagents on Streptavidin-coated ELISA plates.

The analysis was performed with peptides that were selected based on their reactivity with the individual sera, which were included in the serum pools used for preparations of IgG and IgA screening reagents for bacterial surface display. A summary for serum reactivity of 74 peptides representing 55 different S. agalactiae antigenic proteins from the genomic screen analyzed with 22 human sera (from 13 patient and 9 healthy exposed high titer individuals) used for the antigen identification is shown in Table 2 and Table 6. The peptides were compared by the score calculated for each peptide based on the number of positive sera and the extent of reactivity. Peptides range from highly and widely reactive to weakly positive ones.

Example 5

Gene Distribution Studies with Highly Immunogenic Proteins Identified from S. agalactiae.

Experimental Procedures

Gene distribution of GBS antigens by PCR. An ideal vaccine antigen would be an antigen that is present in all, or the vast majority of strains of the target organism to which the vaccine is directed. In order to establish whether the genes encoding the identified Streptococcus agalactiae antigens occur ubiquitously in S. agalactiae strains, PCR was performed on a series of independent S. agalactiae isolates with primers specific for the gene of interest. S. agalactiae isolates were obtained covering the serotypes most frequently present in patients as shown in FIG. 4A. Oligonucleotide sequences as primers were designed for all identified ORFs yielding products of approximately 1,000 bp, if possible covering all identified immunogenic epitopes. Genomic DNA of all S. agalactiae strains was prepared as described under Example 2. PCR was performed in a reaction volume of 25 µl using Taq polymerase (1U), 200 nM dNTPs, 10 pMol of each oligonucleotide and the kit according to the manufacturers instructions (Invitrogen, The Netherlands). As standard, 30 cycles (1×: 5 min. 95° C., 30×: 30 sec. 95° C., 30 sec. 56° C., 30 sec. 72° C., 1×4 min. 72° C.) were performed, unless conditions had to be adapted for individual primer pairs.

Results

Identified genes encoding immunogenic proteins were tested by PCR for their presence in 46 different strains of S. agalactiae (FIG. 4A). As an example, FIG. 4B shows the PCR reaction for GBS0061 with all indicated 46 strains. As clearly visible, the gene is present in all strains analyzed. The PCR fragment from a type IA strain was sequenced and showed that all 657 bp were identical as compared to the S. agalactiae ATCC 12403 strain, indicating a high level of conservation between the two isolates. From a total of 117 genes analyzed, more than 100 were present in all or almost all strains tested, while only 5 genes were absent in more than 10% of the tested 46 strains (Table 3). In addition, only few genes (e.g. GBS0016, GBS1087, GBS1528 and GBS2018) showed variation in size but were present in all or most strain isolates. Sequencing of the generated PCR fragment from one strain and subsequent comparison to the type III strain ATCC 12403 confirmed the amplification of the correct DNA fragment and revealed a degree of sequence divergence as indicated in Table 3. Importantly, many of the identified antigens are well conserved in all strains in sequence and size and are therefore novel vaccine candidates to prevent infections by GBS.

Example 6

Characterization of Immune Sera Obtained from Mice Immunized with Highly Immunogenic Proteins/peptides from S. agalactiae Displayed on the Surface of E. coli.

Experimental Procedures

Generation of Immune Sera from Mice

E. coli clones harboring plasmids encoding the platform protein fused to a S. agalactiae peptide, were grown in LB medium supplemented with 50 μg/ml Kanamycin at 37° C. Overnight cultures were diluted 1:10, grown until an $OD_{600}$ of 0.5 and induced with 0.2 mM IPTG for 2 hours. Pelleted bacterial cells were suspended in PBS buffer and disrupted by sonication on ice, generating a crude cell extract. According to the $OD_{600}$ measurement, an aliquot corresponding to $5×10^7$ cells was injected into NMRI mice i.v., followed by a boost after 2 weeks. Serum was taken 1 week after the second injection. Epitope specific antibody levels were measured by peptide ELISA.

In vitro Expression of Antigens

Expression of antigens by in vitro grown S. agalactiae serotype III was tested by immunoblotting. Different growth media and culture conditions were tested to detect the presence of antigens in total lysates and bacterial culture supernatants. Expression was considered confirmed when a specific band corresponding to the predicted molecular weight and electrophoretic mobility was detected. ps Cell Surface Staining Flow cytometric analysis was carried out as follows. Bacteria were grown under culture conditions, which resulted in expression of the antigen as shown by the immunoblot analysis. Cells were washed twice in Hanks Balanced Salt Solution (HBSS) and the cell density was adjusted to approximately $1×10^6$ CFU in 100 μl HBSS, 0.5% BSA. After incubation for 30 to 60 min at 4° C. with mouse antisera diluted 50 to 100-fold, unbound antibodies were washed away by centrifugation in excess HBSS, 0.5% BSA. Secondary goat anti-mouse antibody ($F(ab')_2$ fragment specific) labeled with fluorescein (FITC) was incubated with the cells at 4° C. for 30 to 60 min. After washing, cells were fixed with 2% paraformaldehyde. Bound antibodies were detected using a Becton Dickinson FACScan flow cytometer and data further analyzed with the computer program CELLQuest. Negative control sera included mouse pre-immune serum and mouse polyclonal serum generated with lysates prepared from IPTG induced E. coli cells transformed with plasmids encoding the genes lamB or fhuA without S. agalactiae genomic insert.

Bactericidal (Killing) Assay

Murine macrophage cells (RAW246.7 or P388.D1) and bacteria were incubated and the loss of viable bacteria after 60 min was determined by colony counting. In brief, bacteria were washed twice in Hanks Balanced Salt Solution (HBSS) and the cell density was adjusted to approximately $1×10^5$ CFU in 50 μl HBSS. Bacteria were incubated with mouse sera (up to 25%) and guinea pig complement (up to 5%) in a total volume of 100 μl for 60 min at 4° C. Pre-opsonized bacteria were mixed with macrophages (murine cell line RAW264.7 or P388.D1; $2×10^6$ cells per 100 μl) at a 1:20 ratio and were incubated at 37° C. on a rotating shaker at 500 rpm. An aliquot of each sample was diluted in sterile water and incubated for 5 min at room temperature to lyse macrophages. Serial dilutions were then plated onto Todd-Hewitt Broth agar plates. The plates were incubated overnight at 37° C., and the colonies were counted with the Countermat flash colony counter (IUL Instruments). Control sera included mouse pre-immune serum and mouse polyclonal serum generated with lysates prepared from IPTG induced E. coli transformed with plasmids harboring the genes lamB or fhuA without S. agalactiae genomic insert.

Results

Immunogenicity in mice. The presence of specific antibodies was determined by peptide ELISA and/or immunoblotting using the E. coli clone expressing the given epitope embedded in LamB or FhuA platform proteins, as it is exemplified in FIG. 5A and B, respectively, and summarized in Table 4 and Table 7. 43 novel GBS antigens represented by 61 different epitope regions were shown to be immunogenic in mice. Positive sera were then analyzed by immunoblotting using total bacterial lysates and culture supernatants prepared from S. agalactiae serotype III strain (data not shown). This analysis served as a first step to determine whether the antigenic proteins were expressed, and if, under which growth conditions, in order to evaluate surface expression of the polypeptide by FACS analysis. It was anticipated based on literature data that not all proteins would be expressed under in vitro conditions.

Cell surface staining of S. agalactiae. Cell surface accessibility for several antigenic proteins was subsequently demonstrated by an assay based on flow cytometry. GBS cells were incubated with preimmune and polyclonal mouse sera raised against S. agalactiae lysate or E. coli clones harboring plasmids encoding the platform protein fused to a S. agalactiae peptide, followed by detection with fluorescently tagged secondary antibody. As shown in FIG. 6A, antisera raised against S. agalactiae lysate contains antibodies against surface components, demonstrated by a significant shift in fluorescence of the S. agalactiae serotype III cell population. Similar cell surface staining of S. agalactiae serotype III cells was observed with polyclonal sera raised against peptides of many of the GBS antigens identified (FIG. 6B ). In some instances, a subpopulation of the bacteria was not stained, as indicated by the detection of two peaks in the histograms (FIG. 6B). This phenomenon may be a result of differential expression of the gene products during the growth of the bacterium, insufficient antibody levels or partial inhibition of antibody binding caused by other surface molecules or plasma proteins. Importantly, a well-known protective GBS antigen, Sip/gbs0031 is proved to be also positive in this assay.

In vitro bactericidal activity. Opsonophagocytic killing is the cornerstone of host defense against extracellular bacteria, such as S. agalactiae. Cell surface binding of antibodies to bacterial antigens are opsonizing and induce killing (bactericidal) by phagocytic cells (macrophages and neutrophil granulocytes) if the antibodies induced by the particular antigens can bind activated complement components (C3bi). In FIG. 7 data are presented on bactericidal activity measured by antigen-specific antibodies generated in mice with corresponding epitopes. According to these data, several of the novel GBS antigens, for example gbs0012, gbs0016, gbs0428, gbs1306 and gbs2018 induce functional antibodies. Importantly, a well-known protective GBS antigen, Sip/gbs0031 is proved to be strongly positive in the very same assay.

These experiments confirmed the bioinformatic prediction that many of the proteins are exported due to their signal peptide sequence and in addition showed that they are present on the cell surface of S. agalactiae serotype III. They also confirm that these proteins are available for recognition by human antibodies with functional properties and make them valuable candidates for the development of a vaccine against GBS diseases.

TABLE 1A

Immunogenic proteins identified by bacterial surface display.

| S. agalactiae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| gbs0012 | weakly similar to beta-lactamase | 4–20, 35–44, 65–70, 73–87, 92–98, 112–137, 152–161, 177–186, 193–200, 206–213, 229–255, 282–294, 308–313, 320–326, 349–355, 373–384, 388–406, 420–425 | B: 13, C: 6 | 115–199 | 1, 218 |
| gbs0016 | glucan-binding protein B | 5–24, 35–41, 44–70, 103–109, 127–143, 155–161, 185–190, 192–207, 212–219, 246–262, 304–336, 372–382, 384–393, 398–407, 412–418, 438–444 | B: 12, C: 4, D: 3, E: 5, H: 4, I: 12, M: 2 | 1–75, 76–161, 164–239 | 2, 219 |
| gbs0024 | phosphoribosylformyl glycinamidine synthase | 4–10, 16–58, 60–71, 77–92, 100–126, 132–146, 149–164, 166–172, 190–209, 214–220, 223–229, 241–256, 297–312, 314–319, 337–343, 351–359, 378–387, 398–418, 421–428, 430–437, 440–448, 462–471, 510–519, 525–536, 552–559, 561–568, 573–582, 596–602, 608–630, 637–649, 651–665, 681–702, 714–732, 739–745, 757–778, 790–805, 807–815, 821–829, 836–842, 846–873, 880–903, 908–914, 916–923, 931–940, 943–948, 956–970, 975–986, 996–1015, 1031–1040, 1051–1069, 1072–1095, 1114–1119, 1130–1148, 1150–1157, 1169–1176, 1229–1238 | F: 4 | 802–812 | 3, 220 |
| gbs0031 | surface immunogenic protein | 5–12, 14–26, 35–47, 52–67, 72–78, 83–98, 121–141, 152–159, 163–183, 186–207, 209–257, 264–277, 282–299, 301–309, 312–318, 324–339, 358–368, 372–378, 387–397, 425–431 | A: 17, B: 53, C: 36, D: 4 | 46–291 | 4, 221 |
| gbs0048 | Hypothetical protein | 29–38, 44–64, 70–76, 78–87, 94–100, 102–112, 119–134, 140–149, 163–173, 178–186, 188–194, 207–234, 247–262, 269–290 | K: 13 | 73–92 | 5, 222 |
| gbs0053 | aldehyde-alcohol dehydrogenase (adhE) | 10–28, 36–63, 77–87, 103–119, 127–136, 141–169, 171–183, 195–200, 207–232, 236–246, 251–265, 268–283, 287–297, 314–322, 335–343, 354–363, 384–390, 405–411, 419–436, 443–455, 467–473, 480–513, 518–529, 550–557, 565–585, 602–608, 616–625, 632–660, 665–677, 685–701, 726–736, 738–747, 752–761, 785–796, 801–813, 838–853, 866–871 | E: 4 | 757–774 | 6, 223 |
| gbs0061 | rplB ribosomal protein L2 | 31–38, 61–66, 74–81, 90–115, 123–145, 154–167, 169–179, 182–193, 200–206, 238–244, 267–272 | F: 2, I: 12 | 235–251 | 7, 224 |
| gbs0084 | DNA-directed RNA polymerase, alpha subunit (rpoA) | 19–25, 38–54, 56–64, 66–72, 74–92, 94–100, 116–129, 143–149, 156–183, 204–232, 253–266, 269–275, 294–307 | C: 4, D: 6 | 241–313 | 8, 225 |
| gbs0107 | conserved hypothetical protein | 5–34, 50–56, 60–65, 74–85, 89–97, 108–119, 159–165, 181–199, 209–225, 230–240, 245–251, 257–262, 274–282, 300–305 | K: 2 | 64–75 | 9, 226 |
| gbs0108 | deoxyuridine 5'-triphosphate nucleotidohydrolase | 5–13, 16–21, 27–42, 45–52, 58–66, 74–87, 108–114, 119–131 | I: 5 | 39–51 | 10, 227 |
| gbs0113 | ribose ABC transporter | 6–23, 46–54, 59–65, 78–84, 100–120, 128–133, 140–146, 159–165, 171–183, 190–204, 224–232, 240–248, 250–259, 274–280, 288–296, 306–315 | F: 4 | 267–274 | 11, 228 |
| gbs0123 | similar to argininosuccinate synthase | 5–12, 15–24, 26–36, 42–65, 68–80, 82–104, 111–116, 125–144, 159–167, 184–189, 209–218, 235–243, 254–265, 269–283, 287–300, 306–316, 318–336, 338–352, 374–392 | K: 17 | 162–174 | 12, 229 |
| gbs0127 | rpmV 50S ribosomal protein L28 | 30–42, 45–54 | F: 11 | 25–37 | 13, 230 |

TABLE 1A-continued

Immunogenic proteins identified by bacterial surface display.

| S. agalactiae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| gbs0144 | oligopeptide ABC transporter, substrate-binding | 10–30, 53–59, 86–95, 116–130, 132–147, 169–189, 195–201, 212–221, 247–256, 258–265, 278–283, 291–298, 310–316, 329–339, 341–352, 360–367, 388–396, 398–411, 416–432, 443–452, 460–466, 506–512, 515–521, 542–548 | E: 7 | 419–431 | 14, 231 |
| gbs0183 | membrane protein, putative | 4–27, 30–53, 60–67, 70–90, 92–151, 159–185, 189–195, 198–210, 215–239 | F: 9 | 173–189 | 15, 232 |
| gbs0184 | oligopeptide ABC transporter, oligopeptide-binding | 4–26, 41–54, 71–78, 116–127, 140–149, 151–158, 161–175, 190–196, 201–208, 220–226, 240–252, 266–281, 298–305, 308–318, 321–329, 344–353, 372–378, 384–405, 418–426, 429–442, 457–463, 494–505, 514–522 | E: 6 | 174–188 | 16, 233 |
| gbs0235 | glycine betaine/carnitine/choline ABC transporter | 17–25, 27–39, 61–67, 81–89, 99–110, 120–131, 133–139, 147–161, 167–172, 179–185, 192–198, 203–213, 226–238, 243–258, 261–267, 284–290, 296–307, 311–328, 340–352, 356–371 | G: 8, H: 15 | 239–256 | 17, 234 |
| gbs0255 | conserved hypothetical protein | 8–30, 40–49, 67–80, 114–123, 126–142, 152–162, 188–194 | E: 2 | 57–70 | 18, 235 |
| gbs0260 | glycyl-tRNA synthetase (beta subunit) | 4–23, 28–34, 36–47, 50–61, 76–81, 89–94, 96–104, 112–119, 126–146, 155–181, 195–200, 208–214, 220–229, 244–260, 263–276, 282–288, 292–300, 317–323, 336–351, 353–359, 363–375, 382–399, 415–432, 444–455, 458–471, 476–481, 484–492, 499–517, 522–529, 535–541, 543–568, 572–584, 586–600, 607–617, 626–637, 656–675 | F: 3 | 282–297 | 19, 236 |
| gbs0268 | transketolase (tkt) | 6–24, 30–35, 38–45, 63–91, 134–140, 146–160, 167–188, 214–220, 226–234, 244–250, 260–270, 286–301, 316–329, 340–371, 429–446, 448–459, 474–481, 485–491, 512–526, 537–544, 550–565, 573–583, 596–613, 621–630, 652–658 | E: 7 | 87–97 | 20, 237 |
| gbs0286 | NH3-dependent NAD+ synthetase | 8–20, 26–48, 56–67, 76–86, 94–109, 115–121, 123–129, 143–160, 178–186, 191–198, 201–208, 221–236, 238–244, 260–268 | F: 12, G: 7, H: 8 | 237–247 | 21, 238 |
| gbs0288 | similar to penicillin-binding protein 1A | 4–40, 42–57, 73–87, 98–117, 126–135, 150–156, 166–174, 196–271, 231–236, 248–258, 276–284, 293–301, 307–313, 339–347, 359–365, 375–387, 395–402, 428–440, 445–456, 485–490, 497–505, 535–541, 547–555, 610–625, 648–656, 665–671 | D: 5, K: 3 | 448–528 | 22, 239 |
| gbs0343 | seryl-tRNA synthetase (serS) | 10–18, 39–45, 51–61, 80–96, 98–106, 110–115, 158–172, 174–183, 191–200, 220–237, 249–255, 274–289, 308–324, 331–341, 372–381, 384–397, 405–414 | I: 3 | 322–338 | 23, 240 |
| gbs0411 | Hypothetical protein | 30–36, 38–56, 85–108, 134–147, 149–160, 163–183, 188–201, 206–211, 219–238, 247–254 | I: 11 | 5–13 | 24, 241 |
| gbs0428 | similar to fibrinogen binding protein, putative peptidoglycan linked protein (LPXTG motif) | 11–40, 98–103, 110–115, 133–145, 151–159, 172–179, 192–201, 204–212, 222–228, 235–245, 258–268, 283–296, 298–309, 322–329, 342–351, 354–362, 372–378, 385–393, 407–418, 495–516 | A: 7, B: 2, C: 31 | 1–148 | 25, 242 |
| gbs0437 | glucose-6-phosphate isomerase (pgi) | 5–19, 21–36, 73–94, 112–119, 122–137, 139–145, 152–167, 184–190, 198–204, 208–224, 249–265, 267–281, 299–304, 309–317, 326–333, 356–364, 368–374, 381–389, 391–414, 419–425, 430–435 | I: 26 | 113–140 | 26, 243 |

TABLE 1A-continued

Immunogenic proteins identified by bacterial surface display.

| S. agalactiae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| gbs0460 | decarboxylase | 45–54, 59–67, 78–91 | I: 7, K: 11 | 15–23 | 27, 244 |
| gbs0465 | oxydoreductase | 11–22, 33–47, 52–80, 88–112, 124–129 | F: 4 | 6–25 | 28, 245 |
| gbs0470 | similar to alpha protein, putative peptidoglycan linked protein (LPXTG motif) | 26–41, 51–63, 80–89, 93–115, 150–163, 187–193, 220–237, 240–249, 286–294, 296–306, 316–329, 345–353, 361–370, 407–425, 428–437, 474–482, 484–494, 504–517, 533–541, 549–558, 595–613, 616–625, 660–668, 673–685, 711–726, 736–744, 749–761, 787–802, 812–820, 825–837, 863–878, 888–896, 901–913, 939–954, 964–972, 977–989, 1003–1008, 1016–1022, 1028–1034, 1041–1053, 1059–1074, 1101–1122 | B: 4, C: 2, D: 8 | 420–511, 581–704 | 29, 246 |
| gbs0489 | acetyltransferase, GNAT family | 18–25, 27–55, 71–83, 89–95, 102–113, 120–146, 150–156, 174–185 | E: 32 | 159–175 | 30, 247 |
| gbs0492 | gbs0492 valyl-tRNA synthetase | 24–30, 38–56, 63–68, 87–93, 136–142, 153–164, 183–199, 213–219, 226–234, 244–261, 269–278, 283–289, 291–297, 320–328, 330–336, 340–346, 348–356, 358–366, 382–387, 401–408, 414–419, 449–455, 468–491, 504–512, 531–537, 554–560, 597–608, 621–627, 632–643, 650–662, 667–692, 703–716, 724–737, 743–758, 783–794, 800–818, 846–856 | A: 3 | 806–884 | 31, 248 |
| gbs0538 | amino acid ABC transporter (ATP-binding protein) | 4–14, 21–39, 86–92, 99–107, 121–131, 136–144, 147–154, 158–166, 176–185, 193–199, 207–222, 224–230 | G: 1 | 117–136 | 32, 249 |
| gbs0539 | similar to phosphomannomutase | 65–76, 85–97, 103–109, 115–121, 125–146, 163–169, 196–205, 212–219, 228–237, 241–247, 254–262, 269–288, 294–303, 305–313, 328–367, 395–401, 405–412, 418–429, 437–447, 481–488, 506–513, 519–524, 530–541, 546–557 | K: 4 | 266–284 | 33, 250 |
| gbs0555 | beta-lactam resistance factor (fibA) | 5–14, 37 42, 49–71, 78–92, 97–112, 127–136, 147–154, 156–163, 186–198, 216–225, 233–243, 248–253, 295–307, 323–332, 359–366, 368–374, 380–398 | E: 3 | 194–223 | 34, 251 |
| gbs0579 | dipeptidase | 4–11, 33–39, 45–72, 100–113, 119–129, 136–144, 169–175, 177–185, 200–208, 210–219, 262–276, 278–297, 320–326, 336–344, 347–362, 381–394, 443–453 | I: 4 | 438–454 | 35, 252 |
| gbs0580 | zinc ABC transporter, zinc-binding adhesion, lipoprotein | 4–29, 31–52, 55–61, 95–110, 138–158, 162–171, 179–187, 202–229, 239–248, 251–256, 262–267, 269–285, 304–310, 351–360, 362–368, 381–388, 415–428, 435–440, 448–458 | I: 11 | 161–178 | 36, 253 |
| gbs0628 | cell wall surface anchor family protein (IPxTG) | 4–17, 19–28, 32–43, 47–59, 89–110, 112–126, 128–134, 140–148, 152–161, 169–184, 191–204, 230–235, 255–264, 328–338, 341–347, 401–409, 413–419, 433–441, 449–458, 463–468, 476–482, 486–492, 500–506, 529–545 | I: 9, H: 1 | 305–381 | 37, 254 |
| gbs0632 | cell wall surface anchor family protein, putative (FPKTG motive) | 10–29, 38 45, 53–61, 134–145, 152–160, 163–170, 202–208, 219–229, 248–258, 266–275, 282–288, 315–320, 328–334, 377–385, 392–402, 418–424, 447–453, 460–471, 479–487, 491–497, 500–507, 531–537, 581–594, 615–623, 629–635, 644–652, 659–666, 668–678, 710–717, 719–728, 736–741, 747–760, 766–773, 784–789, 794–800, 805–817, 855–861, 866–887 | H: 3 | 698–715 | 38, 255 |
| gbs0634 | putative surface protein | 16–26, 29–37, 44–58, 62–68, 74–80, 88–95, 97–120, 125–144, 165–196 | H: 1 | 58–72 | 39, 256 |
| gbs0667 | regulatory protein, | 14–21, 23–46, 49–60, 63–74, 78–92, 96–103, 117–129, 134–161, | I: 2 | 243–257 | 40, 257 |

TABLE 1A-continued

Immunogenic proteins identified by bacterial surface display.

| S. agalactiae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| gbs0672 | putative, truncation transcriptional regulator (GntR family) | 169–211, 217–231, 239–248, 252–281, 292–299, 313–343 | G: 11 | 43–76 | 41, 258 |
| gbs0687 | Hypothetical protein | 11–27, 46–52, 67–72, 76–84, 91–112, 116–153, 160–175, 187–196, 202–211, 213–220 | I: 4 | 120–130 | 42, 259 |
| gbs0785 | Similar to penicillin binding protein 2B | 5–29, 37–56, 78–86, 108–118, 152–161 | K: 3 | 184–196 | 43, 260 |
| | | 8–14, 19–41, 52–66, 75–82, 87–92, 106–121, 127–133, 136–143, 158–175, 180–187, 196–204, 221–228, 239–245, 259–265, 291–306, 318–323, 328–340, 352–358, 361–368, 375–381, 391–399, 411–418, 431–442, 446–455, 484–496, 498–510, 527–533, 541–549, 558–565, 575–585, 587–594, 644–655, 661–668, 671–677 | | | |
| gbs0811 | beta-glucosidase | 4–22, 29–38, 55–62, 75–81, 102–107, 110–134, 143–150, 161–167, 172–179, 191–215, 223–233, 241–247, 251–264, 266–272, 288–309, 340–352, 354–366, 394–402, 414–438 | L: 13 | 198–218 | 44, 261 |
| gbs0828 | hypothetical protein | 24–44, 49–70, 80–91, 105–118, 128–136, 140–154 | I: 3 | 77–92 | 45, 262 |
| gbs0851 | hypothetical protein | 5–22, 31–36, 41–47, 67–74, 83–90, 105–122, 135–143, 160–167 | E: 2 | 118–129 | 46, 263 |
| gbs0865 | hypothetical protein | 4–25, 33–73, 81–93, 96–106, 114–120, 122–128, 130–172, 179–208, 210–241, 251–283, 296–301 | K: 4 | 92–100 | 47, 264 |
| gbs0890 | exonuclease RexB (rexB) | 14–24, 29–38, 43–50, 52–72, 86–97, 101–107, 110–125, 127–141, 145–157, 168–175, 177–184, 186–195, 205–226, 238–250, 255–261, 284–290, 293–304, 307–314, 316–323, 325–356, 363–371, 383–390, 405–415, 423–432, 442–454, 466–485, 502–511, 519–527, 535–556, 558–565, 569–574, 612–634, 641–655, 672–686, 698–709, 715–722, 724–732, 743–753, 760–769, 783–792, 818–825, 830–839, 842–849, 884–896, 905–918, 926–940, 957–969, 979–1007, 1015–1021, 1049–1057 | E: 5 | 336–349 | 48, 265 |
| gbs0896 | similar to acetoin dehydrogenase | 6–16, 26–31, 33–39, 62–73, 75–85, 87–100, 113–123, 127–152, 157–164, 168–181, 191–198, 208–214, 219–226, 233–254, 259–266, 286–329 | K: 2 | 181–195 | 49, 266 |
| gbs0898 | acetoin dehydrogenase, thymine PPi dependent | 4–13, 32–39, 53–76, 99–108, 110–116, 124–135, 137–146, 149–157, 162–174, 182–190, 207–231, 242–253, 255–264, 274–283, 291–323, 334–345, 351–360, 375–388, 418–425, 456–474, 486–492, 508–517, 520–536, 547–560, 562–577 | E: 13, F: 2, I: 2, J: 2 | 31–45, 419–443 | 50, 267 |
| gbs0904 | phosphoglucomutase/ phosphomannomutase family protein | 15–26, 30–37, 42–49, 58–90, 93–99, 128–134, 147–154, 174–179, 190–197, 199–205, 221–230, 262–274, 277–287, 300–314, 327–333, 343–351, 359–377, 388–396, 408–413, 416–425, 431–446 | I: 3 | 246–256 | 51, 268 |
| gbs0918 | weakly similar to histidine triad protein, putative lipoprotein | 5–26, 34–42, 47–54, 61–67, 71–104, 107–115, 131–138, 144–153, 157–189, 196–202, 204–210, 228–245, 288–309, 316–329, 332–341, 379–386, 393–399, 404–412, 414–421, 457–468, 483–489, 500–506, 508–517, 523–534, 543–557, 565–580, 587–605, 609–617, 619–627, 631–636, 640–646, 662–668, 675–682, 705–710, 716–723, 727–732, 750–758, 784–789, 795–809, 869–874 | B: 5, C: 11, D: 36, E: 3, K: 3 | 14–138, 166–286, 372–503, 674–696, 754–859 | 52, 269 |
| gbs0931 | pyruvate kinase | 5–17, 32–38, 40–47, 80–89, 113–119, 125–137, 140–154, 157–163, 170–177, 185–199, 213–225, 228–236, 242–248, 277–290, | F: 78 | 116–124 | 53, 270 |

TABLE 1A-continued

Immunogenic proteins identified by bacterial surface display.

| S. agalactiae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| gbs0947 | similar to L-Lactate Dehydrogenase | 292–305, 323–333, 347–353, 364–370, 385–394, 399–406, 423–433, 441–451, 462–474, 477–487 | K: 28 | 63–72 | 54, 271 |
| gbs0948 | DNA gyrase, A subunit (gyrA) | 7–16, 18–30, 32–49, 53–61, 63–85, 95–101, 105–115, 119–134, 143–150, 159–178, 185–202, 212–229, 236–250, 254–265, 268–294 | I: 4 | 358–370 | 55, 272 |
| gbs0969 | similar to unknown plasmid protein | 4–12, 19–47, 73–81, 97–103, 153–169, 188–198, 207–213, 217–223, 236–242, 255–265, 270–278, 298–305, 309–317, 335–347, 354–363, 373–394, 419–424, 442–465, 486–492, 500–507, 542–549, 551–558, 560–572, 580–589, 607–614, 617–623, 647–653, 666–676, 694–704, 706–714, 748–754, 765–772, 786–792, 795–806 | E: 3 | 290–305 | 56, 273 |
| gbs0971 | similar to putative plasmid replication protein | 18–28, 30–38, 40–46, 49–55, 69–78, 82–98, 104–134, 147–153, 180–190, 196–202, 218–236, 244–261, 266–273, 275–286, 290–295, 301–314, 378–387, 390–395, 427–434 | K: 17 | 108–125 | 57, 274 |
| gbs0972 gbs0983 | Hypothetical protein similar to plasmid protein | 4–13, 20–31, 39–51, 54–61, 69–84, 87–105, 117–124 24–34, 43–54, 56–66, 68–79 5–43, 71–77, 102–131, 141–148, 150–156, 159–186, 191–207, 209–234, 255–268, 280–286, 293–299, 317–323, 350–357, 363–372, 391–397, 406–418, 428–435, 455–465, 484–497, 499–505, 525–531, 575–582, 593–607, 621–633, 638–649, 655–673, 684–698, 711–725, 736–741, 743–752, 759–769, 781–793, 813–831, 843–853, 894–905, 908–916, 929–946, 953–963, 970–978, 1001–1007, 1011–1033 | E: 3 D: 11, E: 2, F: 2, J: 10, K: 10, L: 46, M: 3 | 50–69 165–178, 818–974 | 58, 275 59, 276 |
| gbs0986 | surface antigen proteins, putative peptidoglycan bound | 16–44, 63–86, 98–108, 185–191, 222–237, 261–274, 282–294, 335–345, 349–362, 374–384, 409–420, 424–430, 440–447, 453–460, 465–473, 475–504, 522–534, 538–551, 554–560, 567–582, 598–607, 611–619, 627–640, 643–653, 655–661, 669–680, 684–690, 701–707, 715–731, 744–750, 756–763, 768–804, 829–837, 845–853, 855–879, 884–890, 910–928 | B: 3, C: 12, D: 2, E: 3, F: 20, H: 3, I: 3, J: 5, M: 2 | 77–90, 144–212, 279–355, 434–536, 782–810, 875–902 | 60, 277 |
| gbs0988 | similar to plasmid surface exclusion protein, putative peptidoglycan bound protein (LPXTG motif) | 4–22, 29–41, 45–51, 53–66, 70–77, 86–95, 98–104, 106–124, 129–135, 142–151, 153–161, 169–176, 228–251, 284–299, 331–337, 339–370, 380–387, 393–398, 406–411, 423–433, 440–452, 461–469, 488–498, 501–516, 523–530, 532–559, 562–567, 570–602, 612–628, 630–645, 649–659, 666–672, 677–696, 714–723, 727–747 | J: 2 | 212–227 | 61, 278 |
| gbs0991 | ATP-dependent Clp protease, ATP-binding subunit ClpA | 4–9, 17–31, 35–41, 56–61, 66–75, 81–87, 90–124, 133–138, 149–163, 173–192, 213–219, 221–262, 265–275, 277–282, 292–298, 301–307, 333–346, 353–363, 371–378, 419–430, 435–448, 456–469, 551–570, 583–599, 603–612 | F: 15 | 275–291 | 62, 279 |
| gbs0993 | similar to plasmid proteins | 28–34, 53–58, 72–81, 100–128, 145–154, 159–168, 172–189, 217–225, 227–249, 256–263, 299–309, 322–330, 361–379, 381–388, 392–401, 404–417, 425–436, 440–446, 451–464, 469–487, 502–511, 543–551, 559–564, 595–601, 606–612, 615–626, 633–642, 644–650, 664–670, 674–684, 692–701, 715–723 | B: 2, F: 2, J: 4, K: 2, M: 7 | 654–669, 1400–1483 | 63, 280 |

TABLE 1A-continued

Immunogenic proteins identified by bacterial surface display.

| S. agalactiae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| gbs0995 | hypothetical protein | 726–734, 749–756, 763–771, 781–787, 810–843, 860–869, 882–889, 907–917, 931–936, 941–948, 951–958, 964–971, 976–993, 1039–1049, 1051–1065, 1092–1121, 1126–1132, 1145–1151, 1158–1173, 1181–1192, 1194–1208, 1218–1223, 1229–1243, 1249–1254, 1265–1279, 1287–1297, 1303–1320, 1334–1341, 1343–1358, 1372–1382, 1406–1417, 1419–1425, 1428–1434, 1441–1448, 1460–1473, 1494–1504, 1509–1514, 1529–1550 | H: 3, I: 39, J: 3, M: 3 | 205–230, 733–754 | 64, 281 |
| gbs0997 | hypothetical protein | 10–16, 20–25, 58–65, 97–109, 118–132, 134–146, 148–155, 186–195, 226–233, 244–262, 275–284, 295–310, 317–322, 330–339, 345–351, 366–375, 392–403, 408–415, 423–430, 435–444, 446–457, 467–479, 486–499, 503–510, 525–537, 540–585, 602–612, 614–623, 625–634, 639–645, 650–669, 700–707, 717–724, 727–739 | D: 2, F: 52 | 194–213 | 65, 282 |
| gbs0998 | hypothetical protein | 5–22, 37–43, 72–81, 105–113, 128–133, 148–160, 188–194, 204–230, 238–245, 251–257 | I: 2 | 62–68 | 66, 283 |
| gbs1001 | hypothetical protein | 16–21, 35–41, 56–72, 74–92, 103–109 | G: 8 | 220–235 | 67, 284 |
| gbs1015 | hypothetical protein conserved | 4–15, 17–82, 90–104, 107–159, 163–170, 188–221, 234–245, 252–265 | K: 17 | 30–42 | 68, 285 |
| gbs1035 | hypothetical protein | 16–22, 36–46, 61–75, 92–107, 113–121, 139–145, 148–160 | E: 3 | 328–346 | 69, 286 |
| | | 4–12, 20–26, 43–49, 55–62, 66–78, 121–127, 135–141, 146–161, 164–170, 178–189, 196–205, 233–238, 269–279, 288–318, 325–332, 381–386, 400–407 | | | |
| gbs1041 | hypothetical protein | 5–12, 31–49, 57–63, 69–79, 89–97, 99–114, 116–127, 134–142, 147–154, 160–173, 185–193, 199–204, 211–222, 229–236, 243–249, 256–274 | L: 2 | 58–68 | 70, 287 |
| gbs1066 | hypothetical protein | 10–20, 28–34, 39–53, 68–79, 84–90, 99–106 | K: 2 | 73–79 | 71, 288 |
| gbs1087 | FbsA | 14–37, 45–50, 61–66, 77–82, 93–98, 109–114, 125–130, 141–146, 157–162, 173–178, 189–194, 205–210, 221–226, 237–242, 253–258, 269–274, 285–290, 301–306, 316–332, 349–359, 371–378, 385–406 | A: 7, B: 2, C: 4, E: 277, G: 523, J: 25 | 34–307, 312–385 | 72, 289 |
| gbs1103 | ABC transporter (ATP-binding protein) | 4–10, 17–38, 50–85, 93–99, 109–116, 128–185, 189–197, 199–210, 223–256, 263–287, 289–312, 327–337, 371–386, 389–394, 406–419, 424–432, 438–450, 458–463, 475–502, 507–513, 519–526, 535–542, 550–567 | I: 5 | 361–376 | 73, 290 |
| gbs1116 | xanthine permease (pbuX) | 10–39, 42–93, 100–144, 155–176, 178–224, 230–244, 246–255, 273–282, 292–301, 308–325, 332–351, 356–361, 368–379, 386–393, 400–421 | I: 48 | 138–155 | 74, 291 |
| gbs1126 | similar to plasmid unknown protein | 5–11, 17–34, 40–45, 50–55, 72–80, 101–123, 145–151, 164–172, 182–187, 189–195, 208–218, 220–241, 243–252, 255–270, 325–331, 365–371, 391–398, 402–418, 422–428, 430–435, 443–452, 463–469, 476–484, 486–494, 503–509, 529–553, 560–565, 570–590, 608–614, 619–627, 654–661, 744–750, 772–780, 784–790, 806–816, 836–853, 876–885, 912–918, 926–933, 961–975, 980–987, 996–1006, 1016–1028, 1043–1053, 1057–1062 | E: 2, K: 3 | 994–1003, 1033–1056 | 75, 292 |
| gbs1143 | putative | 17–45, 64–71, 73–81, 99–109, 186–192, 223–238, 262–275, 283–295, | C: 3, D: 2, F: 15, | 274–350, 443–513 | 76, 293 |

TABLE 1A-continued

Immunogenic proteins identified by bacterial surface display.

| S. agalactiae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| | peptidoglycan linked protein (LPXTG) | 336–346, 350–363, 375–385, 410–421, 425–431, 441–448, 454–463, 468–474, 476–512, 523–537, 539–552, 568–583, 599–608, 612–620, 628–641, 644–654, 656–662, 670–681, 685–695, 702–708, 716–723, 725–735, 757–764, 769–798, 800–806, 808–816, 826–840, 846–854, 856–862, 874–881, 885–902, 907–928 | J: 3 | | 77, 294 |
| gbs1145 | surface exclusion protein Sec10 | 4–22, 29–41, 45–51, 53–61, 70–76, 85–92, 99–104, 111–122, 134–140, 142–154, 163–174, 224–232, 255–265, 273–279, 283–297, 330–335, 337–348, 356–367, 373–385, 391–396, 421–431, 442–455, 475–485, 493–505, 526–538, 544–561, 587–599, 605–620, 622–651, 662–670, 675–681, 687–692, 697–712, 714–735 | C: 2 | 252–262 | 78, 295 |
| gbs1158 | Similar to oxidoreductase | 4–12, 15–35, 40–46, 50–59, 67–94, 110–128, 143–169, 182–188, 207–215, 218–228, 238–250 | K: 2 | 74–90 | 79, 296 |
| gbs1165 | cysteine desulphurase (iscS-1) | 9–18, 42–58, 78–85, 88–95, 97–106, 115–122, 128–134, 140–145, 154–181, 186–202, 204–223, 261–267, 269–278, 284–293, 300–336, 358–368 | F: 5 | 12–29 | 80, 297 |
| gbs1195 | staphylokinase and streptokinase | 7–34, 46–53, 62–72, 82–88, 100–105, 111–117, 132–137, 144–160, 166–180, 183–189, 209–221, 231–236, 246–253, 268–282, 286–293, 323–336, 364–372, 378–392, 422–433 | B: 3, C: 2, D: 2, G: 3, H: 8 | 388–405 | 81, 298 |
| gbs1209 | ATP-dependent DNA helicase PcrA | 21–27, 34–50, 72–77, 80–95, 164–177, 192–198, 202–220, 226–236, 239–247, 270–279, 285–292, 315–320, 327–334, 348–355, 364–371, 388–397, 453–476, 488–497, 534–545, 556–576, 582–588, 601–607, 609–616, 642–662, 674–681, 687–697, 709–715, 721–727, 741–755 | C: 3, I: 5 | 621–739 | 82, 299 |
| gbs1214 | conserved hypothetical protein | 4–14, 16–77, 79–109 | B: 2 | 25–99 | 83, 300 |
| gbs1242 | CpsG, beta-1,4-galactosyltransferase | 4–9, 17–23, 30–37, 44–55, 65–72, 77–93, 102–121, 123–132, 146–153 | L: 24 | 17–29 | 84, 301 |
| gbs1260 | ABC transporter, ATP-binding protein | 4–18, 25–41, 52–60, 83–92, 104–112, 117–123, 149–155, 159–167, 170–192, 201–210, 220–227, 245–250 | I: 17 | 124–137 | 85, 302 |
| gbs1270 | gbs1270 hyaluronate lyase | 8–25, 50–55, 89–95, 138–143, 148–153, 159–169, 173–179, 223–238, 262–268, 288–295, 297–308, 325–335, 403–409, 411–417, 432–446, 463–475, 492–501, 524–530, 542–548, 561–574, 576–593, 604–609, 612–622, 637–654, 665–672, 678–685, 720–725, 731–739, 762–767, 777–783, 820–838, 851–865, 901–908, 913–920, 958–970, 1000–1006, 1009–1015, 1020–1026, 1043–1052, 1055–1061 | C: 19, D: 5, L: 19 | 1–128, 252–341, 771–793, 1043–1058 | 86, 303 |
| gbs1305 gbs1306 | hypothetical protein Laminin binding protein | 16–26, 33–46 4–27, 69–77, 79–101, 117–123, 126–142, 155–161, 171–186, 200–206, 213–231, 233–244, 267–273, 313–329, 335–344, 347–370, 374–379, 399–408, 422–443, 445–453, 461–468, 476–482, 518–534, 544–553, 556–567, 578–595, 601–620, 626–636, 646–658, 666–681, 715–721, 762–768, 778–785, 789–803, 809–819 | I: 2 A: 6, B: 7, C: 17, D: 72, E: 8, F: 91, G: 2, H: 4, I: 26, J: 3, K: 14 | 64–76 22–108, 153–318, 391–527, 638–757 | 86, 303 87, 304 |
| gbs1307 | Lmb, laminin- | 6–21, 32–43, 62–92, 104–123, 135–141, 145–152, 199–216, 218–226, | A: 2, D: 3 | 1–72, 127–211 | 88, 305 |

TABLE 1A-continued

Immunogenic proteins identified by bacterial surface display.

| S. agalactiae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| gbs1308 | binding surface protein C5a peptidase, authentic frameshift | 237–247, 260–269, 274–283, 297–303<br>6–26, 50–56, 83–89, 108–114, 123–131, 172–181, 194–200, 221–238, 241–247, 251–259, 263–271, 284–292, 304–319, 321–335, 353–358, 384–391, 408–417, 424–430, 442–448, 459–466, 487–500, 514–528, 541–556, 572–578, 595–601, 605–613, 620–631, 635–648, 660–670, 673–679, 688–693, 702–708, 716–725, 730–735, 749–755, 770–777, 805–811, 831–837, 843–851, 854–860, 863–869, 895–901, 904–914, 922–929, 933–938, 947–952, 956–963, 1000–1005, 1008–1014, 1021–1030, 1097–1103, 1120–1130, 1132–1140 | B: 4, C: 15, D: 70, E: 18, F: 26, G: 5, H: 4, J: 2, K: 40 | 1–213, 269–592, 992–1120 | 89, 306 |
| gbs1309 | hypothetical protein | 9–16, 33–39, 47–59, 65–79, 81–95, 103–108, 115–123, 138–148, 163–171, 176–185, 191–196, 205–211, 213–221, 224–256, 261–276, 294–302, 357–363, 384–390 | E: 2, F: 4, H: 2, J: 2 | 95–111, 161–189 | 90, 307 |
| gbs1311 | transposase, C-terminal part | 21–27, 35–45, 70–76, 92–105, 129–143, 145–155, 161–166, 170–191, 204–211, 214–231, 234–246, 249–255, 259–275 | F: 3 | 1–18 | 91, 308 |
| gbs1321 | hypothetical protein | 21–35, 45–53, 56–64, 69–97 | F: 7 | 1–16 | 92, 309 |
| gbs1352 | putative helicase and methylase | 25–33, 41–47, 61–68, 86–101, 106–114, 116–129, 134–142, 144–156, 163–176, 181–190, 228–251, 255–261, 276–292, 295–305, 334–357, 368–380, 395–410, 424–429, 454–460, 469–482, 510–516, 518–527, 531–546, 558–570, 579–606, 628–636, 638–645, 651–656, 668–674, 691–698, 717–734, 742–754, 765–770, 792–797, 827–835, 847–859, 874–881, 903–909, 926–933, 942–961, 964–977, 989–1004, 1010–1028, 1031–1047, 1057–1075, 1081–1095, 1108–1117, 1138–1144, 1182–1189, 1193–1206, 1220–1229, 1239–1246, 1257–1267, 1271–1279, 1284–1301, 1312–1320, 1329–1335, 1341–1347, 1358–1371, 1399–1404, 1417–1426, 1458–1463, 1468–1476, 1478–1485, 1493–1506, 1535–1541, 1559–1574, 1583–1590, 1595–1601, 1603–1611, 1622–1628, 1634–1644, 1671–1685, 1689–1696, 1715–1720, 1734–1746, 1766–1775, 1801–1806, 1838–1844, 1858–1871, 1910–1917, 1948–1955, 1960–1974, 2000–2015, 2019–2036, 2041–2063 | E: 3, H: 2, M: 4 | 748–847, 1381–1391 | 93, 310 |
| gbs1356 | Putative peptidoglycan linked protein (LPXTG motif) - Agglutinin receptor | 5–12, 18–24, 27–53, 56–63, 96–113, 119–124, 131–136, 157–163, 203–209, 215–223, 233–246, 264–273, 311–316, 380–389, 393–399, 425–433, 445–450, 457–462, 464–470, 475–482, 507–513, 527–535, 542–548, 550–565, 591–602, 607–613, 627–642, 644–664, 673–712, 714–732, 739–764, 769–782, 812–818, 826–838, 848–854, 860–871, 892–906, 930–938, 940–954, 957–973, 990–998, 1002–1021, 1024–1033, 1037–1042, 1050–1060, 1077–1083, 1085–1092, 1100–1129, 1144–1161, 1169–1175, 1178–1189, 1192–1198, 1201–1207, 1211–1221, 1229–1239, 1250–1270, 1278–1292, 1294–1300, 1314–1335, 1344–1352, 1360–1374, 1394–1405, 1407–1414, 1416–1424, 1432–1452, 1456–1462, 1474–1497, 1500–1510, 1516–1522, 1534–1542, 1550–1559, 1584–1603, 1608–1627 | C: 5, D: 62, I: 22 | 187–273, 306–441 | 94, 311 |

TABLE 1A-continued

Immunogenic proteins identified by bacterial surface display.

| S. agalactiae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| gbs1376 | similar to ATP-dependent Clp proteinase (ATP-binding subunit), ClpL | 70–80, 90–97, 118–125, 128–140, 142–148, 154–162, 189–202, 214–222, 224–232, 254–260, 275–313, 317–332, 355–360, 392–398, 425–432, 448–456, 464–470, 476–482, 491–505, 521–528, 533–546, 560–567, 592–597, 605–614, 618–626, 637–644, 646–653, 660–666, 677–691 | K: 4 | 207–227 | 95, 312 |
| gbs1377 | similar to homocysteine S-methyltransferase | 5–19, 26–34, 37–55, 57–66, 69–83, 86–102, 115–134, 138–143, 154–172, 178–195, 209–246, 251–257, 290–302, 306–311 | M: 2 | 256–266 | 96, 313 |
| gbs1386 | hydroxy-3-methylglutaryl-coenzyme A synthase | 10–20, 22–28, 35–57, 72–79, 87–103, 108–128, 130–144, 158–171, 190–198, 225–242, 274–291, 301–315, 317–324, 374–385 | G: 2 | 353–365 | 97, 314 |
| gbs1390 | hypothetical protein | 4–9, 17–30, 34–54, 59–66, 73–94, 118–130, 135–150, 158–171, 189–198, 219–239, 269–275, 283–301 | E: 3, K: 4 | 89–106, 176–193 | 98, 315 |
| gbs1391 | hypothetical protein | 14–20, 22–74, 77–86, 89–99, 104–109, 126–135, 154–165, 181–195, 197–212, 216–224, 264–275 | E: 3 | 107–118 | 99, 316 |
| gbs1403 | similar to 5′-nucleotidase, putative peptidoglycan bound protein (LPXTN) | 4–18, 21–38, 63–72, 101–109, 156–162, 165–179, 183–192, 195–210, 212–218, 230–239, 241–256, 278–290, 299–311, 313–322, 332–341, 348–366, 386–401, 420–426, 435–450, 455–460, 468–479, 491–498, 510–518, 532–538, 545–552, 557–563, 567–573, 586–595, 599–609, 620–626, 628–636, 652–657, 665–681 | A: 3, C: 12, D: 4, J: 2 | 1–198 | 100, 317 |
| gbs1408 | Similar to ABC transporter (ATP-binding protein) | 4–10, 16–38, 51–68, 73–79, 94–115, 120–125, 132–178, 201–208, 216–223, 238–266, 269–295, 297–304, 337–342, 347–356, 374–401, 403–422, 440–447, 478–504, 510–516, 519–530, 537–544 | D: 2, K: 4 | 191–206 | 101, 318 |
| gbs1420 | similar to cell wall proteins, putative peptidoglycan linked protein (LPXTG motif) | 12–40, 42–48, 66–71, 77–86, 95–102, 113–120, 129–137, 141–148, 155–174, 208–214, 218–225, 234–240, 256–267, 275–283, 300–306, 313–321, 343–350, 359–367, 370–383, 398–405, 432–439, 443–461, 492–508, 516–526, 528–535 | C: 3, D: 4 | 370–478 | 102, 319 |
| gbs1429 | hypothetical protein | 6–14, 20–37, 56–62, 90–95, 97–113, 118–125, 140–145, 161–170, 183–202, 237–244, 275–284, 286–305, 309–316, 333–359, 373–401, 405–412 | B: 2, C: 2 | 176–187 | 103, 320 |
| gbs1442 | hypothetical thiamine biosynthesis protein, ThiI | 33–44, 50–55, 59–80, 86–101, 129–139, 147–153, 157–163, 171–176, 189–201, 203–224, 239–245, 257–262, 281–287, 290–297, 304–320, 322–331, 334–350, 372–390, 396–401 | L: 28 | 71–88, 353–372 | 104, 321 |
| gbs1452 | rplT 50S ribosomal protein L20 | 5–11, 15–24, 26–33, 40–47, 75–88, 95–103, 105–112 | E: 2 | 17–30 | 105, 322 |
| gbs1464 | ferrichrome ABC transporter (permease) | 5–11, 16–39, 46–54, 62–82, 100–107, 111–124, 126–150, 154–165, 167–183, 204–238, 245–295, 301–313, 316–335 | F: 4 | 8–16 | 106, 323 |
| gbs1470 | conserved hypothetical protein | 4–19, 34–48, 69–74, 79–107, 115–127, 129–135, 143–153, 160–169, 171–182 | I: 4 | 142–153 | 107, 324 |
| gbs1528 | conserved hypothetical protein | 4–30, 65–74, 82–106, 110–120, 124–132, 135–140, 146–175, 179–184, 190–196, 217–223, 228–233, 250–267, 275–292, 303–315, 322–332 | I: 7 | 174–186 | 108, 325 |

TABLE 1A-continued

Immunogenic proteins identified by bacterial surface display.

| S. agalactiae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| gbs1529 | Putative peptidoglycan bound protein (LPXTG motif) | 9–16, 29–41, 47–57, 68–84, 87–109, 113–119, 162–180, 186–193, 195–201, 203–208, 218–230, 234–243, 265–271, 281–292, 305–312, 323–332, 341–347, 349–363, 368–374, 383–390, 396–410, 434–440, 446–452, 455–464, 466–473, 515–522, 529–542, 565–570, 589–600, 602–613, 618–623, 637–644, 1019–1027, 1238–1244, 1258–1264, 1268–1276, 1281–1292, 1296–1302 | C: 2 | 883–936 | 109, 326 |
| gbs1531 | UvrB excinuclease ABC chain B | 10–17, 23–32, 39–44, 54–72, 75–81, 88–111, 138–154, 160–167, 178–185, 201–210, 236–252, 327–334, 336–342, 366–376, 388–400, 410–430, 472–482, 493–526, 552–558, 586–592, 598–603, 612–621, 630–635, 641–660 | M: 2 | 384–393 | 110, 327 |
| gbs1533 | glutamine ABC transporter, glutamine-binding protein | 4–22, 24–39, 50–59, 73–84, 100–105, 111–117, 130–138, 155–161, 173–178, 182–189, 205–215, 266–284, 308–313, 321–328, 330–337, 346–363, 368–374, 388–395, 397–405, 426–434, 453–459, 482–492, 501–507, 509–515, 518–523, 527–544, 559–590, 598–612, 614–629, 646–659, 663–684, 686–694, 698–721 | I: 4 | 445–461 | 111, 328 |
| gbs1536 | hypothetical protein | 14–22, 27–33 | E: 10 | 3–17 | 112, 329 |
| gbs1542 | oxidoreductase, aldo/keto reductase family | 29–41, 66–73, 81–87, 90–108, 140–146, 150–159, 165–184, 186–196, 216–226, 230–238, 247–253, 261–269 | I: 13 | 126–140 | 113, 330 |
| gbs1547 | small protein, SmpB | 5–12, 16–25, 27–33, 36–45, 60–68, 83–88, 103–126 | L: 11 | 86–101 | 114, 331 |
| gbs1565 | hypothetical protein | 14–23, 36–47, 56–66, 84–89, 94–105, 111–127, 140–153, 160–174, 176–183, 189–203, 219–225, 231–237, 250–257 | F: 2, J: 2, K: 8, L: 21 | 194–227 | 115, 332 |
| gbs1586 | peptidyl-prolyl cis-trans isomerase, cyclophilin-type | 4–25, 54–60, 64–71, 73–82, 89–106, 117–124, 157–169, 183–188, 199–210, 221–232, 236–244, 255–264 | E: 3 | 58–98 | 116, 333 |
| gbs1591 | 5-methylthioadenosine nucleosidase/S-adenosylhomocysteine nucleosidase (pfs) | 13–19, 26–36, 41–53, 55–71, 77–84, 86–108, 114–135, 157–172, 177–183, 187–194, 208–213, 218–226 | I: 18, L: 2 | 110–125, 156–170 | 117, 334 |
| gbs1632 | similar to branched-chain amino acid ABC transporter, amino acid-binding protein | 5–24, 63–69, 77–85, 94–112, 120–137, 140–146, 152–159, 166–172, 179–187, 193–199, 206–212, 222–228, 234–240, 244–252, 257–264, 270–289, 298–309, 316–328, 337–348, 363–375 | B: 2, E: 4, I: 3 | 1–56, 340–352 | 118, 335 |
| gbs1638 | amino acid permease | 18–39, 42–71, 78–120, 124–144, 152–173, 179–189, 199–209, 213–222, 228–258, 269–304, 329–361, 364–372, 374–389, 396–441 | E: 8, G: 9, H: 9 | 313–327 | 119, 336 |
| gbs1662 | conserved hypothetical protein | 19–25, 91–98, 108–120, 156–162, 168–174, 191–204, 211–216, 232–266, 272–278, 286–308, 316–321, 327–333, 344–355, 358–364, 384–391, 395–428, 464–476, 487–495, 497–511, 544–561, 563–573, 575–582, 588–594 | E: 3, H: 2 | 10–25, 322–338 | 120, 337 |
| gbs1666 | SWI/SNF family | 14–26, 32–49, 51–57, 59–72, 80–91, 102–112, 119–125, 147–161, | F: 4 | 90–103 | 121, 338 |

TABLE 1A-continued

Immunogenic proteins identified by bacterial surface display.

| S. agalactiae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| | helicase | 164–173, 175–183, 188–213, 217–222, 246–254, 260–276, 282–303, 308–318, 321–328, 333–350, 352–359, 371–378, 392–401, 407–414, 416–443, 448–463, 471–484, 490–497, 501–514, 519–527, 539–551, 557–570, 578–590, 592–598, 600–610, 618–629, 633–647, 654–667, 676–689, 702–709, 718–726, 728–737, 741–760, 764–780, 786–795, 808–826, 836–842, 845–852, 865–874, 881–887, 931–945, 949–957, 968–974, 979–986, 1003–1009, 1023–1029 | E: 2 | 72–90 | 122, 339 |
| gbs1673 | conserved hypothetical protein | 11–16, 37–56, 60–66, 69–77, 80–88, 93–106, 117–139, 166–171 | I: 8 | 115–128 | 123, 340 |
| gbs1695 | dihydroxyacetone kinase family protein | 59–84, 123–133, 145–150, 161–167, 178–189 | I: 2 | 132–142 | 124, 341 |
| gbs1754 | excinuclease ABC, A subunit (uvrA) | 15–33, 39–46, 52–64, 74–87, 108–124, 127–144, 150–156, 173–179, 184–194, 201–208, 219–236, 243–269, 272–295, 302–309, 343–349, 356–361, 370–379, 405–411, 414–423, 430–451, 457–464, 466–475, 477–483, 496–502, 507–522, 541–548, 557–563, 571–577, 579–585, 590–605, 626–642, 650–662, 671–691, 704–710, 751–769, 775–781, 786–791, 794–829, 851–858, 868–878, 884–904, 913–919, 931–939 | | | |
| gbs1760 | Similar to A/G-specific adenine glycosylase | 33–58, 64–71, 74–80, 83–88, 96–120, 122–139, 146–157, 167–177, 207–213, 220–225, 236–242, 264–279, 300–305, 326–336, 340–347, 350–360 | K: 8 | 97–115, 199–211 | 125, 342 |
| gbs1777 | glycerol uptake facilitator protein, putative | 4–26, 43–57, 70–99, 102–117, 121–133, 142–148, 151–168, 170–183, 192–220, 235–249, 258–279 | E: 4 | 30–41 | 126, 343 |
| gbs1783 | polyprenyl synthetase family protein | 34–42, 48–58, 70–94, 110–130, 154–160, 164–172, 178–183, 195–203, 211–222, 229–250, 256–261, 274–284, 286–292, 312–323 | I: 3 | 222–233 | 127, 344 |
| gbs1784 | ABC transporter, ATP-binding protein CydC | 4–9, 15–36, 38–45, 49–74, 78–88, 100–112, 136–191, 211–220, 226–233, 239–246, 254–274, 287–307, 316–322, 342–353, 356–366, 373–378, 384–393, 405–431, 449–457, 459–468, 487–511, 515–524, 529–541, 544–552, 562–568, 571–576 | C: 2, D: 2 | 208–280 | 128, 345 |
| gbs1790 | hypothetical protein | 10–27, 31–37, 39–54, 71–108, 124–143 | A: 23, C: 6 | 2–107 | 129, 346 |
| gbs1805 | Similar to secreted unknown protein | 16–27, 38–57, 64–70, 90–102, 104–113, 116–137, 160–166 | A: 197, C: 2 | 1–80 | 130, 347 |
| gbs1816 | HD domain protein | 13–21, 31–36, 56–67, 127–136, 153–171, 173–180, 184–200, 214–222, 225–231, 239–263, 267–273 | F: 8 | 135–159 | 131, 348 |
| gbs1821 | Similar to 23S ribosomal RNA methyltransferase | 12–27, 31–51, 68–74, 77–87, 94–101, 108–114, 117–123, 127–134, 138–168, 173–196, 201–207, 212–217, 227–237, 247–257, 264–280 | K: 5 | 205–223 | 132, 349 |
| gbs1823 | triad family protein | 17–22, 25–54, 70–76, 92–100 | G: 6, H: 3 | 98–110 | 133, 350 |
| gbs1834 | two-component sensor histidine kinase | 7–29, 40–50, 60–67, 87–96, 105–111, 119–164, 172–199, 206–212, 220–227, 237–259, 272–279, 282–293, 295–309, 313–319, 321–328, 345–363, 376–386 | E: 3, F: 6 | 159–176 | 134, 351 |
| gbs1842 | transcriptional antiterminator, BglG | 4–19, 24–30, 36–43, 50–68, 71–89, 93–106, 141–152, 154–172, 179–197, 199–215, 229–239, 246–252, 255–263, 281–298, | I: 19 | 362–377 | 135, 352 |

TABLE 1A-continued

Immunogenic proteins identified by bacterial surface display.

| S. agalactiae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| gbs1850 | hypothetical transaldolase family | 319–325, 329–356, 358–368, 374–390, 397–409, 420–429, 432–444, 450–456, 459–475, 483–494, 496–502, 520–528, 532–556 | G: 2 | 122–140 | 136, 353 |
| gbs1869 | phosphoglycerate kinase | 18–25, 40–62, 77–85, 91–97, 105–116, 123–133, 139–184, 189–197 | L: 9 | 643–658 | 137, 354 |
| gbs1875 | alkyl hydroperoxide reductase (large subunit) and NADH dehydrogenase | 4–49, 52–58, 62–70, 79–105, 109–133, 142–150, 163–168, 206–214, 220–228, 233–240, 243–254, 274–281, 303–311, 327–338, 357–373, 378–396, 403–413, 420–436, 441–453, 461–467, 475–481, 484–498, 506–512, 514–521, 523–529, 562–579, 589–595, 598–603, 615–648, 714–722, 728–742, 749–758, 777–792, 795–807 | F: 3 | 456–470 | 138, 355 |
| gbs1879 | endopeptidase O (pepO) | 8–27, 37–48, 51–56, 72–79, 87–106, 120–138, 140–147, 167–176, 187–197, 205–216, 222–229, 234–239, 243–249, 277–288, 292–315, 334–343, 347–353, 363–391, 398–404, 430–447, 461–467, 478–492, 498–507 | I: 26 | 221–237 | 139, 356 |
| gbs1893 | 2-keto-3-deoxygluconate kinase | 5–12, 18–24, 59–69, 80–93, 95–109, 119–125, 130–137, 139–147, 158–163, 168–176, 182–202, 206–215, 222–239, 241–249, 267–277, 291–298, 311–318, 321–327, 338–344, 348–355, 373–386, 393–406, 411–417, 434–443, 446–465, 473–484, 514–521, 532–553, 584–594 | F: 8, K: 9 | 167–191 | 140, 357 |
| gbs1899 | N-acetylmuramoyl-L-alanine amidase, family 4 protein | 4–14, 27–34, 50–58, 63–72, 79–106, 109–114, 121–142, 146–154, 161–167, 169–175, 178–201, 223–238, 249–254, 259–264, 278–292, 294–312, 319–330 | B: 2, C: 2, E: 3 | 140–190 | 141, 358 |
| gbs1907 | citrate carrier protein, CCS family | 7–28, 36–42, 50–61, 63–80, 122–152, 161–174, 176–191 | I: 2 | 381–395 | 142, 359 |
| gbs1924 | similar to pneumococcal histidine triad protein B precursor (C-terminal part) | 20–57, 59–65, 70–78, 86–102, 119–133, 142–161, 163–173, 177–188, 192–202, 204–220, 222–236, 240–253, 279–319, 326–331, 337–383, 390–399, 406–412, 420–427, 431–438 | K: 3 | 182–201 | 143, 360 |
| gbs1925 | similar to pneumococcal histidine triad protein B precursor (N-terminal part) | 13–18, 28–34, 37–43, 50–59, 75–81, 83–97, 105–121, 139–147, 200–206, 209–227, 231–247, 260–271, 318–327, 366–381, 388–394, 399–406 | A: 2, B: 5, C: 12, D: 57 | 21–314 | 144, 361 |
| gbs1962 | conserved hypothetical protein | 6–29, 37–43, 51–56, 70–77, 82–102, 110–119, 127–143, 178–190, 201–209, 216–243, 261–269, 281–292, 305–313, 327–339, 341–354, 356–373, 391–397, 423–429, 438–445, 450–478 | E: 3 | 90–103 | 145, 362 |
| gbs2008 | similar to C5A peptidase, putative peptidoglycan linked protein (LPXTG motif) | 4–12, 15–21, 32–41, 59–76, 80–89, 96–104 | A: 253, B: 2, C: 3, D: 6, H: 2 | 3–82, 509–576 | 146, 363 |
|  |  | 9–28, 30–41, 44–54, 69–74, 77–82, 90–97, 104–123, 125–135, 149–155, 164–173, 177–184, 217–226, 230–235, 238–244, 258–272, 282–297, 300–305, 309–315, 317–322, 327–336, 348–362, 368–374, 380–387, 400–411, 414–424, 451–458, 460–466, 483–494, 497–503, 506–511, 521–528, 540–553, 569–587, |  |  |  |

TABLE 1A-continued

Immunogenic proteins identified by bacterial surface display.

| S. agalactiae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| gbs2018 | putative peptidoglycan linked protein (LPXTG motif) | 598–606, 628–642, 661–681, 688–700, 718–733, 740–749, 752–764, 769–783, 823–834, 848–854, 862–872, 878–884, 886–898, 915–920, 938–951, 954–961, 963–972, 982–989, 996–1003, 1010–1016, 1021–1032, 1038–1044, 1047–1057, 1060–1070, 1079–1088, 1094–1102, 1117–1127, 1129–1135, 1142–1153, 1158–1204, 1212–1229, 1234–1263, 1269–1277, 1308–1313, 1327–1338, 1344–1376, 1400–1415, 1436–1443, 1448–1458, 1497–1504, 1511–1522, 1544–1566 | A: 132, B: 6, C: 13, D63, E: 15, H: 2, J: 9, K: 13 | 1–60, 55–139, 212–308, 386–458, 458–624 | 147, 364 |
| gbs2029 | hypothetical protein | 8–36, 40–64, 71–79, 88–94, 102–109, 118–127, 138–148, 151–159, 163–174, 192–198, 200–206, 220–233, 268–273, 290–301, 304–309, 316–323, 331–349, 378–391, 414–420, 427–437, 455–475, 494–510, 541–547, 549–555, 616–640 | G: 8 | 273–281 | 148, 365 |
| gbs2042 | hypothetical protein | 16–31, 35–42, 70–77, 91–101, 120–130, 132–140, 143–153, 185–190, 195–202, 215–222, 228–238, 241–251, 257–264, 268–277, 288–302, 312–324, 326–333, 341–348, 364–382, 415–429, 438–454, 458–466, 491–499, 501–521 | L: 11 | 466–490 | 149, 366 |
| gbs2054 | DNA mismatch repair protein HexA | 8–14, 32–57, 74–149, 155–177, 179–212, 221–266, 271–296, 304–324, 329–346, 349–359, 368–401, 413–419, 426–454, 465–478, 493–510 | E: 8 | 102–113 | 150, 367 |
| gbs2058 | hypothetical protein | 22–28, 33–51, 64–89, 96–119, 126–132, 138–146, 152–159, 161–169, 172–179, 193–198, 205–211, 221–231, 235–254, 273–280, 297–303, 312–320, 328–346, 351–373, 378–384, 391–398, 448–454, 460–468, 470–481, 516–558, 574–593, 597–602, 613–623, 626–646, 649–656, 668–673, 675–683, 696–708, 715–722, 724–739, 745–751, 759–777, 780–804, 816–822 | L: 3 | 128–138 | 151, 368 |
| gbs2060 | aspartyl-tRNA synthetase (aspS) | 12–28, 41–91, 98–107, 112–120, 125–131, 151–193, 215–221, 240–250, 263–280 | I: 3, L: 12 | 96–109, 127–139 | 152, 369 |
| gbs2075 | hypothetical protein | 16–24, 32–38, 46–62, 68–81, 90–105, 127–133, 144–150, 160–166, 178–184, 186–202, 210–219, 232–240, 252–258, 264–273, 293–324, 337–344, 349–357, 360–369, 385–398, 410–416, 419–427, 441–449, 458–476, 508–515, 523–539, 544–549, 562–569, 571–579 | M: 2 | 39–53 | 153, 370 |
| gbs2106 | protein of unknown function/lipoprotein, putative | 19–25, 28–34, 56–61, 85–97, 110–116 4–37, 41–50, 62–72, 91–97, 99–109, 114–125, 136–141, 149–158, 160–166, 201–215 | A: 5, B: 6, C: 4, D: 14, E: 11, I: 8, K: 23 | 27–225 | 154, 371 |
| gbs2118 | similar to inosine monophosphate dehydrogenase | 15–31, 44–51, 96–105, 122–130, 149–157, 162–168, 178–183, 185–192, 198–204, 206–213, 221–234, 239–245, 248–255, 257–266, 289–335, 349–357, 415–422, 425–441, 448–454, 462–468 | K: 17 | 463–481 | 155, 372 |
| gbs2131 | ABC transporter, permease protein, putative | 5–31, 39–55, 63–72, 76–99, 106–155, 160–177, 179–199, 207–217, 223–240, 245–255, 261–267, 294–316, 321–343, 354–378, 382–452, 477–488, 529–536, 555–569, 584–591, 593–612, 620–627, 632–640, 647–654, 671–680, 698–704, 723–730, 732–750, 769–775, 781–788, 822–852 | I: 2 | 505–525 | 156, 373 |
| ARF0112 | Hypothetical protein | none | F: 6 | 3–18 | 157, 374 |

TABLE 1A-continued

Immunogenic proteins identified by bacterial surface display.

| S. agalactiae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| ARF0147 | Hypothetical protein | 4–14 | E: 3, I: 3 | 12–24 | 158, 375 |
| ARF0532 | Hypothetical protein | 4–11, 22–30 | F: 10 | 12–25 | 159, 376 |
| ARF0534 | Hypothetical protein | 5–12 | E: 2, G: 2 | 4–18 | 160, 377 |
| ARF0557 | Hypothetical protein | 4–28 | E: 2, G: 6, H: 4 | 7–14 | 161, 378 |
| ARF0862 | Hypothetical protein | 6–16 | G: 7, H: 4 | 8–16 | 162, 379 |
| ARF0891 | Hypothetical protein | 4–15, 18–33 | K: 6 | 24–36 | 163, 380 |
| ARF0895 | Hypothetical protein | 4–10, 16–21 | I: 21 | 20–31 | 164, 381 |
| ARF0943 | Hypothetical protein | none | C: 2, K: 9 | 6–19 | 165, 382 |
| ARF0973 | Hypothetical protein | 11–18 | D: 2, G: 3, H: 8, I: 2, K: 2 | 3–10 | 166, 383 |
| ARF0999 | Hypothetical protein | 13–24 | B: 4, K: 3 | 3–15 | 167, 384 |
| ARF1010 | Hypothetical protein | 15–27 | K: 2 | 7–16 | 168, 385 |
| ARF1230 | Hypothetical protein | 11–16 | K: 11 | 1–15 | 169, 386 |
| ARF1503 | Hypothetical protein | 4–16 | E: 13 | 9–21 | 170, 387 |
| ARF1556 | Hypothetical protein | 4–24, 40–48, 54–67 | F: 2 | 22–39 | 171, 388 |
| ARF1585 | Hypothetical protein | 6–30, 34–55, 62–68, 78–106 | I: 5, J: 4 | 68–74 | 172, 389 |
| ARF1588 | Hypothetical protein | none | I: 2 | 3–14 | 173, 390 |
| ARF1735 | Hypothetical protein | 9–19 | I: 13 | 6–21 | 174, 391 |
| ARF1809 | Hypothetical protein | 4–17 | H: 2, L: 17 | 1–9 | 175, 392 |
| ARF1826 | Hypothetical protein | 5–30 | I: 6 | 1–8 | 176, 393 |
| ARF1882 | Hypothetical protein | 4–16, 23–46, 51–56 | K: 23 | 45–55 | 177, 394 |
| ARF1996 | Hypothetical protein | none | F: 3 | 7–16 | 178, 395 |
| CRF0123 | Hypothetical protein | none | F: 32 | 2–14 | 179, 396 |
| CRF0180 | Hypothetical protein | 4–36, 43–65 | E: 6, G: 6, H: 12 | 50–62 | 180, 397 |
| CRF0208 | Hypothetical protein | 10–30 | I: 2 | 14–21 | 181, 398 |
| CRF0258 | Hypothetical protein | 9–17 | I: 2 | 1–10 | 182, 399 |
| CRF0285 | Hypothetical protein | 4–12 | I: 2 | 3–16 | 183, 400 |
| CRF0311 | Hypothetical protein | 4–15 | H: 4 | 5–23 | 184, 401 |
| CRF0446 | Hypothetical protein | none | L: 20 | 10–21 | 185, 402 |
| CRF0455 | Hypothetical protein | none | F: 5 | 6–16 | 186, 403 |
| CRF0491 | Hypothetical protein | 4–29, 31–38 | G: 4 | 2–14 | 187, 404 |
| CRF0520 | Hypothetical protein | 4–35 | H: 4 | 33–42 | 188, 405 |
| CRF0530 | Hypothetical protein | none | G: 13, H: 8, K: 3 | 2–17 | 189, 406 |
| CRF0570 | Hypothetical protein | 9–18, 30–35 | I: 2 | 15–33 | 190, 407 |
| CRF0649 | Hypothetical protein | 4–9 | G: 8, H: 6 | 6–12 | 191, 408 |
| CRF0853 | Hypothetical protein | none | I: 6 | 3–17 | 192, 409 |
| CRF0955 | Hypothetical protein | 12–21, 37–44, 52–61, 72–80 | E: 7, L: 44 | 38–48 | 193, 410 |
| CRF0983.1 | Hypothetical protein | 4–10, 29–44, 54–61, 69–78 | K: 59 | 13–27 | 194, 411 |
| CRF0983.2 | Hypothetical protein | 13–23, 36–53 | L: 33 | 2–15 | 195, 412 |
| CRF1083 | Hypothetical protein | 4–25, 28–46, 56–72, 81–99, 120–132, 134–142, 154–160 | F: 18 | 129–141 | 196, 413 |
| CRF1095 | Hypothetical protein | 4–15, 24–33, 35–41, 64–86 | L: 15 | 21–33 | 197, 414 |
| CRF1212.1 | Hypothetical protein | 9–15 | I: 5 | 4–13 | 198, 415 |
| CRF1212.2 | Hypothetical protein | 4–11, 13–19, 34–48 | L: 30 | 15–32 | 199, 416 |
| CRF1290 | Hypothetical protein | 4–21 | I: 7 | 11–31 | 200, 417 |
| CRF1383 | Hypothetical protein | 23–57 | K: 13 | 38–50 | 201, 418 |
| CRF1416 | Hypothetical protein | 4–32 | E: 16, J: 7 | 3–13 | 202, 419 |

TABLE 1A-continued

Immunogenic proteins identified by bacterial surface display.

| S. agalactiae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| CRF1500 | Hypothetical protein | 4–10, 13–25, 32–42, 56–68, 72–84 | E: 16 | 26–38 | 203, 420 |
| CRF1513 | Hypothetical protein | 4–20, 31–48, 52–58, 65–71, 80–93, 99–108, 114–123 | I: 2 | 37–49 | 204, 421 |
| CRF1518 | Hypothetical protein | 6–12, 14–20 | F: 28 | 3–25 | 205, 422 |
| CRF1663 | Hypothetical protein | 14–25, 27–38 | F: 10 | 5–14 | 206, 423 |
| CRF1667 | Hypothetical protein | 4–41, 57–105, 109–118, 123–136, 144–152 | G: 4 | 86–99 | 207, 424 |
| CRF1832 | Hypothetical protein | None | E: 5, L: 8 | 6–19 | 208, 425 |
| CRF1866 | Hypothetical protein | none | G: 3, H: 18 | 2–19 | 209, 426 |
| CRF1892 | Hypothetical protein | 14–47 | L: 11 | 1–14 | 210, 427 |
| CRF1942 | Hypothetical protein | 4–21, 29–44 | F: 14 | 2–18 | 211, 428 |
| CRF1992 | Hypothetical protein | 23–29 | K: 10 | 10–28 | 212, 429 |
| CRF2047 | Hypothetical protein | 6–16, 22–36 | K: 9 | 11–22 | 213, 430 |
| CRF2050 | Hypothetical protein | 4–19, 30–44 | I: 2 | 18–27 | 214, 431 |
| CRF2096 | Hypothetical protein | 5–15, 37–45, 58–65 | G: 2 | 38–47 | 215, 432 |
| CRF2113 | Hypothetical protein | 4–15, 23–34 | I: 5 | 4–15 | 216, 433 |
| NRF1311 | transposase, C-terminal part | 30–36, 44–54, 79–85, 101–114, 138–152, 154–164, 170–175, 179–200, 213–220, 223–240, 243–255, 258–264, 268–284 | F: 3 | 10–28 | 217, 434 |

TABLE 1B

Immunogenic proteins identified by amino acid sequence identity with peptides identified by bacterial surface display.

| S. agalactiae antigenic protein (new) | Identical region | Peptide sequence | SEQ ID NO | Peptide name | Protein identified by BSD | Immunogenic region (aa) | Sequence ID (DNA, protein) |
|---|---|---|---|---|---|---|---|
| gbs0384 | 210–226 | MEYKGNFSQKTINRFKS | 489 | gbs0995.1 | gbs0995 | 210–226 | 435, 449 |
|  | 738–753 | QTQRSGKINTDFMRQL | 490 | gbs0995.2 | gbs0995 | 738–753 |  |
| gbs0393 | 326–344 | VKTIGYGKLTGKVNHHYVA | 491 | gbs0986.2 | gbs0986 | 326–344 | 436, 450 |
|  | 326–348 | VKTIGYGKLTGKVNHHYVANKDG | 492 | gbs1143.1 | gbs1143 | 327–349 |  |
|  | 338–354 | VNHHYVANKDGSVTAFV | 493 | gbs0986.3 | gbs0986 | 338–354 |  |
|  | 371–392 | AAVNQNIVFRVLTKDGRPIFEK | 494 | gbs1143.2 | gbs1143 | 372–393 |  |
|  | 801–809 | TVIKKGTNL | 495 | gbs0986.4 | gbs0986 | 801–809 |  |
|  | 877–901 | VTHTTEKSKPVEPQKATPKAPAKGL | 496 | gbs0986.5 | gbs0986 | 877–901 |  |
| gbs0396 | 893–906 | RQELLTPTQLSKLQ | 497 | gbs0983.1 | gbs0983 | 893–906 | 437, 451 |
| gbs0407 | 51–69 | VRYDKLEALVAYHGAKSAS | 498 | gbs0972.1 | gbs0972 | 51–69 | 438, 452 |
| gbs0408 | 110–125 | HQPNRIYLTDKLVPYI | 499 | gbs0971.1 | gbs0971 | 110–125 | 439, 453 |
| gbs0410 | 291–305 | QSIKQHDKEKLRTVL | 500 | gbs0969.1 | gbs0969 | 291–305 | 440, 454 |
| gbs0714 | 210–226 | MEYKGNFSQKTINRFKS | 501 | gbs0995.1 | gbs0995 | 210–226 | 441, 455 |
|  | 738–753 | QTQRSGKINTDFMRQL | 502 | gbs0995.2 | gbs0995 | 738–753 |  |
| gbs0723 | 326–344 | VKTIGYGKLTGKVNHHYVA | 503 | gbs0986.2 | gbs0986 | 326–344 | 442, 456 |
|  | 326–348 | VKTIGYGKLTGKVNHHYVANKDG | 504 | gbs1143.1 | gbs1143 | 327–349 |  |
|  | 338–354 | VNHHYVANKDGSVTAFV | 505 | gbs0986.3 | gbs0986 | 338–354 |  |
|  | 371–392 | AAVNQNIVFRVLTKDGRPIFEK | 506 | gbs1143.2 | gbs1143 | 372–393 |  |
|  | 801–809 | TVIKKGTNL | 507 | gbs0986.4 | gbs0986 | 801–809 |  |
|  | 877–901 | VTHTTEKSKPVEPQKATPKAPAKGL | 508 | gbs0986.5 | gbs0986 | 877–901 |  |
| gbs0726 | 893–906 | RQELLTPTQLSKLQ | 509 | gbs0983.1 | gbs0983 | 893–906 | 443, 457 |
| gbs0737 | 51–69 | VRYDKLEALVAYHGAKSAS | 510 | gbs0972.1 | gbs0972 | 51–69 | 444, 458 |
| gbs0738 | 110–125 | HQPNRIYLTDKLVPYI | 511 | gbs0971.1 | gbs0971 | 110–125 | 445, 459 |
| gbs0740 | 291–305 | QSIKQHDKEKLRTVL | 512 | gbs0969.1 | gbs0969 | 291–305 | 446, 460 |
| gbs0897 | 32–44 | EGDVLLEIMSDKT | 513 | gbs0898.1 | gbs0898 | 32–44 | 447, 461 |
| gbs0966 | 399–410 | PGLTVEEKFVTF | 514 | gbs0144.1 | gbs0144 | 420–431 | 448, 462 |

TABLE 2

Epitope serology with human sera

| Peptides | positivity | aa from | aa to | Seq ID |
|---|---|---|---|---|
| gbs0012.1 | ++ | 120 | 143 | 218 |
| gbs0012.2 | + | 138 | 161 | 218 |
| gbs0012.3 | + | 156 | 179 | 218 |
| bbs0016.2 | +++ | 110 | 129 | 219 |
| gbs0016.3 | + | 168 | 184 | 219 |
| gbs0048.1 | + | 74 | 90 | 222 |
| gbs0053.1 | +++ | 759 | 773 | 223 |
| gbs0061.1 | +++ | 237 | 260 | 224 |
| gbs0084.1 | + | 265 | 284 | 225 |
| gbs0107.1 | ++ | 65 | 74 | 226 |
| gbs0108.1 | ++ | 41 | 50 | 227 |
| gbs0123.1 | + | 163 | 174 | 229 |
| gbs0127.1 | ++ | 26 | 37 | 230 |
| gbs0183.1 | + | 174 | 189 | 232 |
| gbs0235.1 | ++ | 240 | 256 | 234 |
| gbs0260.1 | + | 285 | 297 | 236 |
| gbs0286.1 | + | 238 | 247 | 238 |
| gbs0288.1 | + | 491 | 519 | 239 |
| gbs0437.1 | ++ | 114 | 140 | 243 |
| gbs0539.1 | + | 267 | 284 | 250 |
| gbs0579.1 | + | 439 | 453 | 252 |
| gbs0580.1 | ++ | 162 | 178 | 253 |
| gbs0628.1 | ++ | 347 | 364 | 254 |
| gbs0632.1 | +++ | 699 | 715 | 255 |
| gbs0634.1 | + | 60 | 71 | 256 |
| gbs0667.1 | ++ | 244 | 257 | 257 |
| gbs0672.1 | + | 44 | 63 | 258 |
| gbs0672.2 | + | 57 | 76 | 258 |
| gbs0785.1 | + | 185 | 196 | 260 |
| gbs0851.1 | + | 119 | 129 | 263 |
| gbs0896.1 | ++ | 182 | 195 | 266 |
| gbs0898.1 | ++ | 32 | 44 | 267 |
| gbs0898.2 | + | 424 | 442 | 267 |
| gbs0904.1 | + | 247 | 256 | 268 |
| gbs0918.1 | ++ | 678 | 694 | 269 |
| gbs0918.2 | + | 785 | 805 | 269 |
| gbs0918.4 | + | 55 | 77 | 269 |
| gbs0918.5 | +++ | 72 | 94 | 269 |
| gbs0995.1 | + | 210 | 226 | 281 |
| gbs1087.3 | + | 37 | 59 | 289 |
| gbs1165.1 | + | 13 | 29 | 296 |
| gbs1816.1 | + | 136 | 159 | 348 |
| gbs1821.1 | + | 205 | 222 | 349 |
| gbs1823.1 | + | 99 | 110 | 350 |
| gbs1834.1 | + | 160 | 176 | 351 |
| gbs1875.1 | + | 457 | 470 | 355 |
| gbs1879.1 | + | 221 | 237 | 356 |
| gbs1893.1 | + | 167 | 190 | 357 |
| gbs1925.1 | + | 96 | 120 | 361 |
| gbs2018.3 | +++ | 399 | 417 | 364 |
| gbs2018.4 | +++ | 503 | 519 | 364 |
| gbs2018.5 | +++ | 544 | 563 | 364 |
| gbs2106.2 | + | 46 | 68 | 371 |
| gbs2106.7 | + | 159 | 183 | 371 |
| gbs2106.8 | + | 184 | 198 | 371 |
| gbs2118.1 | ++ | 463 | 481 | 372 |

TABLE 3

Gene distribution in *S. agalactiae* strains.

| ORF | Common name | Gene distribution (present of 50) | Amino acid substitutions (in serotype IA strain)* | Seq. ID (DNA, Prot.) |
|---|---|---|---|---|
| gbs0012 | weakly similar to beta-lactamase | 44/44 | n.d. | 1, 218 |
| gbs0016 | glucan-binding protein B (*S. mutans*) | 40/44 | 0/224 | 2, 219 |
| gbs0024 | Phosphoribosylformylglycinamidine | 46/46 | 10/228 | 3, 220 |
| gbs0031 | surface immunogenic protein | 46/46 | 1/225 | 4, 221 |
| gbs0048 | Unknown | 30/46 | 0/61 | 5, 222 |
| gbs0053 | aldehyde-alcohol dehydrogenase (adhE) | 45/45 | 0/224 | 6, 223 |
| gbs0061 | rplB ribosomal protein L2 | 46/46 | 0/218 | 7, 224 |
| gbs0084 | DNA-directed RNA polymerase, alpha subunit (rpoA) | 45/45 | 0/207 | 8, 225 |
| gbs0107 | conserved hypothetical protein | 46/46 | 0/235 | 9, 226 |
| gbs0108 | deoxyuridine 5'-triphosphate nucleotidohydrolase | 44/44 | 0/125 | 10, 227 |
| gbs0113 | ribose ABC transporter | 44/45 | 0/227 | 11, 228 |
| gbs0123 | similar to argininosuccinate synthase | 44/44 | 0/184 | 12, 229 |
| gbs0127 | rpmV 50S ribosomal protein L28 | 46/46 | 0/40 | 13, 230 |
| gbs0144 | oligopeptide ABC transporter, substrate-binding | 45/45 | 0/282 | 14, 231 |
| gbs0183 | membrane protein, putative | 44/44 | 0/223 | 15, 232 |
| gbs0184 | oligopeptide ABC transporter, oligopeptide-binding | 46/46 | 1/203 | 16, 233 |
| gbs0235 | glycine betaine/carnitine/choline ABC transporter | 46/46 | 0/219 | 17, 234 |
| gbs0255 | conserved hypothetical protein | 46/46 | 0/180 | 18, 235 |
| gbs0260 | glycyl-tRNA synthetase (beta subunit | 46/46 | 0/209 | 19, 236 |
| gbs0268 | transketolase (tkt) | 46/46 | 0/208 | 20, 237 |
| gbs0286 | NH3-dependent NAD+ synthetase | 45/45 | 0/191 | 21, 238 |
| gbs0288 | similar to penicillin-binding protein 1A | 45/45 | 0/212 | 22, 239 |
| gbs0343 | seryl-tRNA synthetase (serS) | 46/46 | 0/228 | 23, 240 |
| gbs0428 | similar to fibrinogen binding protein, putative peptidoglycan linked protein (LPXTG motif) | 45/46 | 1/126 | 25, 242 |
| gbs0437 | glucose-6-phosphate isomerase (pgi) | 45/45 | 0/232 | 26, 243 |
| gbs0460 | decarboxylase | 46/46 | 1/81 | 27, 244 |
| gbs0465 | oxydoreductase | 46/46 | 0/126 | 28, 245 |
| gbs0489 | acetyltransferase, GNAT family | 45/45 | 3/144 | 30, 247 |
| gbs0492 | gbs0492 valyl-tRNA synthetase | 44/44 | 3/125 | 31, 248 |
| gbs0538 | amino acid ABC transporter (ATP-binding protein) | 46/46 | 0/214 | 32, 249 |
| gbs0539 | similar to phosphomannomutase | 46/46 | 0/244 | 33, 250 |
| gbs0555 | beta-lactam resistance factor (fibA) | 46/46 | 0/218 | 34, 251 |
| gbs0579 | dipeptidase | 46/46 | 0/218 | 35, 252 |
| gbs0580 | zinc ABC transporter, zinc-binding adhesion liprot | 45/45 | 2/235 | 36, 253 |
| gbs0628 | cell wall surface anchor family protein - (IPxTG) | 42/44 | 0/219 | 37, 254 |
| gbs0632 | cell wall surface anchor family protein, putative (FPKTG motive) | 44/45 | 0/238 | 38, 255 |
| gbs0667 | regulatory protein, putative, truncation | 44/44 | 0/229 | 40, 257 |
| gbs0672 | transcriptional regulator (GntR family) | 43/43 | 0/203 | 41, 258 |
| gbs0687 | unknown proteins | 45/45 | 0/149 | 42, 259 |
| gbs0785 | Similar to penicillin binding protein 2B | 45/45 | 0/218 | 43, 260 |
| gbs0828 | unknown proteins | 46/46 | 1/120 | 45, 262 |
| gbs0851 | hypothetical protein | 46/46 | 0/140 | 46, 263 |
| gbs0865 | gbs0865 Unknown | 44/44 | 0/241 | 47, 264 |
| gbs0890 | exonuclease RexB (rexB) | 46/46 | 0/232 | 48, 265 |
| gbs0896 | similar to acetoin dehydrogenase | 46/46 | 0/239 | 49, 266 |
| gbs0898 | acetoin dehydrogenase, thymine PPi dependent | 45/45 | 0/180 | 50, 267 |
| gbs0904 | phosphoglucomutase/phosphomannomutase family prote | 46/46 | 0/169 | 51, 268 |
| gbs0918 | weakly similar to histidine triad protein, putative lipoprotein | 45/45 | 1/209 | 52, 269 |
| gbs0931 | pyruvate kinase | 46/46 | 0/185 | 53, 270 |
| gbs0947 | similar to L-Lactate Dehydrogenase | 46/46 | 0/233 | 54, 271 |
| gbs0948 | DNA gyrase, A subunit (gyrA) | 44/44 | 0/172 | 55, 272 |
| gbs1035 | conserved hypothetical protein | 46/46 | 0/210 | 69, 286 |
| gbs1066 | gbs1066 Unknown | 17/46 | 2/92 | 71, 288 |
| gbs1087 | highly repetitive peptidoglycan bound protein (LPXTG motif) | 42/45 | n.d. | 72, 289 |
| gbs1103 | ABC transporter (ATP-binding protein) | 46/46 | 1/165 | 73, 290 |
| gbs1116 | xanthine permease (pbuX) | 45/45 | 1/170 | 74, 291 |
| gbs1158 | Similar to oxidoreductase | 44/44 | 1/170 | 78, 295 |
| gbs1165 | cysteine desulphurase (iscS-1) | 43/43 | 0/148# | 79, 296 |

TABLE 3-continued

Gene distribution in S. agalactiae strains.

| ORF | Common name | Gene distribution (present of 50) | Amino acid substitutions (in serotype IA strain)* | Seq. ID (DNA, Prot.) |
|---|---|---|---|---|
| gbs1195 | staphylokinase and streptokinase | 45/45 | 60/142 | 80, 297 |
| gbs1209 | ATP-dependent DNA helicase PcrA | 43/44 | 1/94# | 81, 298 |
| gbs1214 | conserved hypothetical protein | 43/46 | 0/97 | 82, 299 |
| gbs1260 | ABC transporter, ATP-binding protein | 44/46 | 1/198 | 84, 301 |
| gbs1306 | Laminin binding protein (Spellerberg, B et al 1999) | 45/46 | 0/215 | 87, 304 |
| gbs1307 | lmb laminin-binding surface protein | 45/45 | n.d. | 88, 305 |
| gbs1308 | C5a peptidase, authentic frameshift | 46/46 | 0/205 | 89, 306 |
| gbs1309 | hypothetical protein | 44/46 | 0/214 | 90, 307 |
| gbs1356 | Putative peptidoglycan linked protein (LPXTG motif) - Agglutinin receptor | 20/46 | 50/211# | 94, 311 |
| gbs1376 | similar to ATP-dependent Clp proteinase (ATP-binding subunit), ClpL | 45/45 | 0/197 | 95, 312 |
| gbs1377 | similar to homocysteine S-methyltransferase | 45/45 | 0/55 | 96, 313 |
| gbs1386 | -hydroxy-3-methylglutaryl-coenzyme A synthase | 44/44 | 0/219 | 97, 314 |
| gbs1390 | gbs1390 Unknown | 43/43 | 0/198 | 98, 315 |
| gbs1391 | gbs1391 Unknown | 44/44 | 0/214 | 99, 316 |
| gbs1403 | similar to 5'-nucleotidase, putative peptidoglycan bound protein (LPXTN) | 45/45 | 3/189 | 100, 317 |
| gbs1408 | Similar to ABC transporter (ATP-binding protein) | 45/45 | 0/205 | 101, 318 |
| gbs1429 | unknown proteins | 46/46 | 1/193 | 103, 320 |
| gbs1452 | rplT 50S ribosomal protein L20 | 46/46 | 0/101 | 105, 322 |
| gbs1464 | ferrichrome ABC transporter (permease | 44/44 | 2/232 | 106, 323 |
| gbs1470 | conserved hypothetical protein | 46/46 | 2/164 | 107, 324 |
| gbs1528 | conserved hypothetical protein | 45/45 | 0/213 | 108, 325 |
| gbs1531 | UvrB excinuclease ABC chain B | 45/45 | 0/108 | 110, 327 |
| gbs1533 | glutamine ABC transporter, glutamine-binding prote | 44/44 | 0/166 | 111, 328 |
| gbs1542 | oxidoreductase, aldo/keto reductase family | 45/45 | 1/219 | 113, 330 |
| gbs1565 | hypothetical protein | 43/43 | 1/218 | 115, 332 |
| gbs1586 | peptidyl-prolyl cis-trans isomerase, cyclophilin-type | 45/45 | 1/227 | 116, 333 |
| gbs1591 | 5-methylthioadenosine nucleosidase/S-adenosylhomoc | 45/45 | 0/203 | 117, 334 |
| gbs1632 | similar to branched-chain amino acid ABC transporter, amino acid-binding protein | 45/45 | 0/223 | 118, 335 |
| gbs1638 | amino acid permease | 45/45 | 0/100 | 119, 336 |
| gbs1662 | conserved hypothetical protein | 45/45 | 0/213 | 120, 337 |
| gbs1666 | SWI/SNF family helicase | 45/45 | 0/200 | 121, 338 |
| gbs1673 | conserved hypothetical protein | 45/45 | 0/147 | 122, 339 |
| gbs1695 | dihydroxyacetone kinase family protein | 43/43 | 1/165 | 123, 340 |
| gbs1754 | excinuclease ABC, A subunit (uvrA) | 43/43 | 0/224 | 124, 341 |
| gbs1760 | Similar to A/G-specific adenine glycosylase | 46/46 | 0/181 | 125, 342 |
| gbs1777 | glycerol uptake facilitator protein, putative | 43/43 | 0/199 | 126, 343 |
| gbs1783 | polyprenyl synthetase family protein | 45/45 | 0/217 | 127, 344 |
| gbs1784 | ABC transporter, ATP-binding protein CydC | 45/45 | 1/220 | 128, 345 |
| gbs1790 | unknown proteins | 41/43 | 3/75# | 129, 346 |
| gbs1805 | Similar to secreted unknown proteins | 45/45 | 0/66 | 130, 347 |
| gbs1816 | HD domain protein | 43/43 | 1/176 | 131, 348 |
| gbs1821 | Similar to 23S ribosomal RNA methyltransferase | 43/43 | 2/155# | 132, 349 |
| gbs1834 | two-component sensor histidine kinase | 44/44 | 0/213 | 134, 351 |
| gbs1842 | transcriptional antiterminator, BglG family | 43/43 | 0/208 | 135, 352 |
| gbs1850 | hypothetical transaldolase | 44/44 | 0/194 | 136, 353 |
| gbs1875 | alkyl hydroperoxide reductase (large subunit) and NADH dehydrogenase | 46/46 | 0/192 | 138, 355 |
| gbs1879 | endopeptidase O (pepO) | 43/43 | 0/135 | 139, 356 |
| gbs1893 | 2-keto-3-deoxygluconate kinase | 36/46 | 0/228 | 140, 357 |
| gbs1899 | N-acetylmuramoyl-L-alanine amidase, family 4 prote | 43/43 | 0/149 | 141, 358 |
| gbs1907 | citrate carrier protein, CCS family | 43/43 | 0/219 | 142, 359 |
| gbs1925 | similar to pneumococcal histidine triad protein B precursor (N-terminal part) | 43/43 | 0/103 | 144, 361 |
| gbs1962 | conserved hypothetical protein | 28/46 | 0/136 | 145, 362 |
| gbs2008 | similar to C5A peptidase, putative peptidoglycan linked protein (LPXTG motif) | 43/43 | n.d. | 146, 363 |
| gbs2018 | putative peptidoglycan linked protein (LPXTG motif) | 43/45 | 0/104 | 147, 364 |

TABLE 3-continued

Gene distribution in S. agalactiae strains.

| ORF | Common name | Gene distribution (present of 50) | Amino acid substitutions (in serotype IA strain)* | Seq. ID (DNA, Prot.) |
|---|---|---|---|---|
| gbs2029 | unknown proteins | 44/44 | 1/238 | 148, 365 |
| gbs2054 | DNA mismatch repair protein HexA | 46/46 | 0/206 | 150, 367 |
| gbs2060 | aspartyl-tRNA synthetase (aspS) | 46/46 | 2/211 | 152, 369 |
| gbs2106 | protein of unknown function/lipoprotein, putative | 44/44 | 0/160 | 154, 371 |
| gbs2118 | similar to inosine monophosphate dehydrogenase | 43/43 | 0/113 | 155, 372 |
| gbs2131 | ABC transporter, permease protein, putative | 45/45 | 0/237 | 156, 373 |

TABLE 4

Immunogenicity of epitopes in mice

| ORF | aa from | aa to | IB | Peptide ELISA | Seq ID |
|---|---|---|---|---|---|
| gbs0016 | 110 | 129 | + | | 219 |
|  | 168 | 184 | + | | |
| gbs0986 | 877 | 901 | + | | 277 |
|  | 333 | 354 | + | | |
|  | 326 | 344 | + | | |
|  | 801 | 809 | + | | |
| gbs1805 | 1 | 54 | | +++++ | 347 |
| gbs2018 | 544 | 563 | ++ | +++++ | 364 |
|  | 31 | 51 | + | +++ | |
|  | 107 | 119 | + | | |
|  | 399 | 417 | ++ | ++++ | |
|  | 503 | 519 | + | ++++ | |
| gbs0012 | 120 | 198 | ++ | + | 218 |
| gbs0016 | 20 | 35 | + | ++ | 219 |
| gbs0031 | 118 | 201 | | ++++ | 221 |
| gbs0428 | 48 | 132 | + | +++++ | 242 |
| gbs0538 | 118 | 136 | + | ++++ | 249 |
| gbs0580 | 162 | 178 | + | + | 253 |
| gbs0628 | 347 | 364 | + | +++++ | 254 |
| gbs0632 | 699 | 715 | + | +++++ | 255 |
| gbs0672 | 50 | 76 | | + | 258 |
| gbs0918 | 785 | 819 | + | +++++ | 269 |
|  | 44 | 128 | ++ | | |
| gbs0971 | 90 | 128 | | +++++ | 274 |
| gbs1087 | 314 | 384 | + | | 289 |
| gbs1143 | 327 | 349 | | +++ | 293 |
| gbs1306 | 242 | 314 | ++ | ++++ | 304 |
|  | 405 | 478 | ++ | | |
|  | 23 | 100 | + | | |
| gbs1307 | 129 | 210 | ++ | | 305 |
| gbs1309 | 162 | 188 | | ++ | 307 |
| gbs1352 | 750 | 772 | ++ | +++++ | 310 |
| gbs1632 | 1 | 56 | | ++ | 335 |
| gbs1662 | 322 | 337 | + | +++++ | 337 |
| gbs1673 | 72 | 90 | + | +++++ | 339 |
| gbs1784 | 374 | 395 | | + | 345 |
| gbs1816 | 136 | 159 | + | ++++ | 348 |
| gbs1899 | 141 | 164 | + | | 358 |
| gbs1925 | 96 | 157 | ++ | + | 361 |
| gbs2008 | 1 | 82 | | + | 363 |
| gbs2018 | 489 | 556 | + | +++++ | 364 |
| gbs2106 | 159 | 183 | | ++ | 371 |
|  | 49 | 133 | + | +++++ | |

TABLE 5

Immunogenic proteins identified by bacterial surface display.

| S. agalactiae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| gbs0233 | similar to glycine betaine/carnitine/choline ABC transporter (osmoprotectant-binding protein) | 4–26, 35–41, 53–61, 73–84, 103–108, 114–120, 140–146, 156–162, 192–208, 214–219, 227–233, 239–252, 260–268, 284–297 | A: 5, B: 9, H: 3 | 1–48, 113–133 | 463, 475 |
| gbs0419 | protein of unknown function/lipoprotein | 4–27, 38–44, 50–56, 59–64, 72–79, 83–89, 92–97, 108–116, 123–148, 152–167, 183–196, 200–220, 232–244, 255–261, 265–274, 282–302, 309–317 | C: 3, D: 4, J: 2, K: 4 | 1–79, 231–302 | 464, 476 |
| gbs0456 | cell wall surface anchor family protein | 6–28, 66–72, 85–105, 115–121, 144–151, 160–170, 176–185, 223–230, 252–288, 296–310, 319–333, 367–374, 458–464, 471–480, 483–488, 520–528, 530–549, 559–564, 593–601, 606–616, 636–643, 655–662, 676–682, 684–699, 719–726, 735–750, 757–764, 777–785, 799–810, 812–843, 846–853, 868–873, 880–889, 891–899, 909–929, 934–940, 963–969, 998–1004, 1007–1014, 1016–1022, 1030–1046 | A: 9, B: 125, F: 9 | 1–80, 808–821 | 465, 477 |

TABLE 5-continued

Immunogenic proteins identified by bacterial surface display.

| S. agalactiae antigenic protein | Putative function (by homology) | predicted immunogenic aa** | No. of selected clones per ORF and screen | Location of identified immunogenic region (aa) | Seq. ID (DNA, Prot.) |
|---|---|---|---|---|---|
| gbs0942 | protein of unknown function/lipoprotein | 7–24, 35–41, 75–81, 91–114, 122–132, 137–144, 148–156, 183–192, 194–200, 212–228, 233–238, 251–258, 275–295, 326–332, 337–346 | A: 3, B: 9, C: 2, J: 3 | 1–79, 305–321 | 466, 478 |
| gbs0973 | gid protein (gid) | 31–38, 42–52, 66–72, 86–92, 98–104, 115–122, 127–146, 154–164, 169–187, 198–212, 225–237, 255–269 | D: 2, G: 3, H: 8, I: 2, K: 2 | 13–92, 135–142 | 467, 479 |
| gbs0975 | Unknown protein | 4–36, 39–49, 63–69, 71–77, 81–88, 123–131, 133–139, 160–169, 174–180, 188–194, 210–217, 273–278, 289–300, 317–334, 336–341, 383–401, 425–438 | A: 3, B: 5, C: 5, D: 2, J: 2 | 1–68, 212–270, 402–446 | 468, 480 |
| gbs1038 | permease, putative | 21–29, 31–42, 49–63, 72–79, 81–93, 112–132, 159–165, 188–195, 197–232, 262–267, 279–286, 294–301, 318–326, 348–366, 381–405, 409–426, 436–465, 471–480, 484–492, 497–505, 521–544, 554–561, 567–577, 581–589, 601–609, 611–622, 636–651, 653–667, 669–685, 700–708, 716–722, 729–744, 749–766, 780–786, 789–811, 814–864 | B: 2, C: 3, E: 3, J: 2 | 1–57, 84–106 | 469, 481 |
| gbs1144 | Unknown protein | 6–24, 35–48, 57–63, 72–78, 87–92, 113–119, 123–137, 147–153, 173–181, 212–233 | C: 30 | 1–124 | 470, 482 |
| gbs1279 | conserved domain protein | 13–34, 62–69, 78–83, 86–91, 98–104, 107–115, 146–159, 179–188, 195–205, 209–221, 226–233, 239–253, 276–282, 284–294, 297–308, 331–354, 375–382, 388–399, 421–433, 449–458, 464–469, 472–491, 508–513, 525–531, 534–550, 575–593, 601–618, 629–635, 654–661, 666–680, 706–721, 723–740, 771–805, 810–830, 845–851 | A: 44, B: 2, C: 4 | 1–84 | 471, 483 |
| gbs1441 | conserved hypothetical protein | 4–32, 45–64, 73–83, 86–92, 100–111, 125–147, 157–163, 170–175, 177–188, 226–232, 245–252, 258–274, 320–335, 348–359 | A: 2, B: 8, C: 2 | 1–71 | 472, 484 |
| gbs1677 | sodium transport family protein | 13–40, 43–71, 76–83, 87–101, 109–119, 125–156, 162–175, 182–219, 226–232, 240–262, 270–287, 306–318, 326–342, 344–408, 414–444, 449–456 | B: 3, C: 2, K: 5 | 1–51 | 473, 485 |
| gbs2093 | Membrane protein, putative | 4–16, 18–34, 45–54, 99–108, 134–140, 203–212, 241–257, 266–274, 279–291, 308–315, 330–336, 355–370, 374–382, 402–410, 428–455, 466–472, 474–480, 531–554, 560–566, 572–580, 597–618, 632–660, 664–674, 676–685, 691–705, 708–735, 750–768 | B: 5, C: 8, D: 2 | 1–87, 342–480 | 474, 486 |

TABLE 6

Immune reactivity of epitopes within identified antigens with human sera

| Peptides | Positivity | aa from | aa to | Seq ID |
|---|---|---|---|---|
| gbs0233.1 | + | 115 | 132 | 475 |
| gbs0233.2 | + | 1 | 26 | 475 |
| gbs0419.1 | ++ | 33 | 55 | 476 |
| gbs0942.2 | +++ | 1 | 25 | 478 |
| gbs0973.1 | + | 37 | 61 | 479 |
| gbs0975.1 | + | 1 | 24 | 480 |
| gbs1038.1 | + | 1 | 23 | 481 |
| gbs1144.3 | ++ | 46 | 60 | 482 |
| gbs1279.1 | +++ | 1 | 28 | 483 |
| gbs1279.2 | + | 23 | 50 | 483 |
| gbs1279.3 | ++ | 45 | 71 | 483 |
| gbs1441.1 | + | 1 | 22 | 484 |
| gbs1441.2 | ++ | 17 | 38 | 484 |
| gbs1677.1 | + | 1 | 22 | 485 |
| gbs1677.2 | + | 17 | 38 | 485 |
| gbs2093.1 | + | 1 | 27 | 486 |
| gbs2093.2 | ++ | 22 | 47 | 486 |
| gbs2093.4 | + | 422 | 447 | 486 |

TABLE 7

Immunogenicity of epitopes in mice

| ORF | aa from | aa to | Peptide ELISA | Seq ID |
|---|---|---|---|---|
| gbs0233 | 115 | 132 | ++++ | 475 |
|  | 1 | 47 | ++ |  |
| gbs0419 | 1 | 55 | ++++ | 476 |
| gbs0456 | 22 | 85 | ++ | 477 |
| gbs0942 | 307 | 320 | + | 478 |
|  | 1 | 44 | ++ |  |
| gbs0973 | 15 | 76 | ++ | 479 |
|  | 40 | 92 | +++ |  |
| gbs0975 | 1 | 59 | ++ | 480 |
|  | 213 | 269 | + |  |
|  | 403 | 445 | + |  |
| gbs1038 | 1 | 56 | ++++ | 481 |
|  | 85 | 105 | + |  |
| gbs1144 | 37 | 121 | +++++ | 482 |
| gbs1279 | 1 | 71 | +++++ | 483 |
| gbs1441 | 1 | 38 | +++ | 484 |
| gbs1677 | 1 | 38 | +++ | 485 |
| gbs2093 | 1 | 47 | +++ | 486 |

REFERENCES

Altschul, S., et al. (1990). *Journal of Molecular Biology* 215: 403-10.
Balter, S. et al. In Gram positive pathogens ed. by Fischetti V. A. et al. AMS Press 2000, 154-160.
Bennett, D., et al. (1995). *J Mol Recognit* 8: 52-8.
Brodeur, B., et al. (2000). *Infect Immun* 68: 5610-8.
Burnie, J., et al. (1998). *J Antimicrob Chemother* 41: 319-22.
Campbell, J., et al. (2000). *Obstet Gynecol* 96: 498-503.
Cheng, Q., et al. (2002). *Infect Immun* 70: 6409-15.
Clackson, T., et al. (1991). *Nature* 352: 624-8.
Devereux, J., et al. (1984). *Nucleic acids research* 12: 387-95.
Doherty, E., et al. (2001). *Annu Rev Biophys Biomol Struct* 30: 457-475.
Eisenbraun, M., et al. (1993). *DNA Cell Biol* 12: 791-7.
Etz, H., et al. (2001). *J Bacteriol* 183: 6924-35.
Farley, M. (2001). *Clin Infect Dis* 33: 556-61.
Ganz, T. (1999). *Science* 286: 420-421.
Georgiou, G. (1997). *Nature Biotechnology* 15: 29-34.
Glaser, P., et al. (2002). *Mol Microbiol* 45: 1499-513.
Hashemzadeh-Bonehi, L., et al. (1998). *Mol Microbiol* 30: 676-678.
Heinje, von G (1987) e.g. Sequence Analysis in Molecular Biology, Academic Press.
Hemmer, B., et al. (1999). *Nat Med* 5: 1375-82.
Hoe, N., et al. (2001). *J Infect Dis* 183: 633-9.
Hornef, M., et al. (2002). *Nat Immunol* 3:-1033-40.
Jackson, L., et al. (1995). *Ann Intern Med* 123: 415-20.
Johanson, K., et al. (1995). *J Biol Chem* 270: 9459-71.
Jones, P., et al. (1986). *Nature* 321: 522-5.
Kajava, A., et al. (2000). *J Bacteriol* 182: 2163-9.
Kohler, G., et al. (1975). *Nature* 256: 495-7.
Larsson, C., et al. (1999). *Vaccine* 17: 454-8.
Lewin, A., et al. (2001). *Trends Mol Med* 7: 221-8.
Marks, J., et al. (1992). *Biotechnology (N Y)* 10: 779-83.
McCafferty, J., et al. (1990). *Nature* 348: 552-4.
Michel, J., et al. (1991). *Infect Immun* 59: 2023-8.
Navarre, W., et al. (1999). *Microbiol Mol Biol Rev* 63:174-229.
Nizet, V. & Rubens, C. E. in Gram positive pathogens ed. by Fischetti V. A. et al. ASM Press 2000, pp 125-136.
Okano, H., et al. (1991). *J Neurochem* 56: 560-7.
Oligodeoxynucleotides as Antisense Inhibitors of Gene Expression; CRC Press, Boca Ration, Fla. (1988).
Paoletti, L., et al. (2002). *Semin Neonatol* 7: 315-23.
Paoletti, L., et al. In Gram positive pathogens ed. by Fischetti V. A. et al. ASM Press 2000, pp 137-153.
Phillips-Quagliata, J., et al. (2000). *J Immunol* 165: 2544-55.
Rammensee, H., et al. (1999). *Immunogenetics* 50: 213-9.
Seeger, C., et al. (1984). *Proc Natl Acad Sci U S A* 81: 5849-52.
Shibuya, A., et al. (2000). *Nature Immunology* 1: 441-6.
Skerra, A. (1994). *Gene* 151: 131-5.
Tang, D., et al. (1992). *Nature* 356:152-4.
Tempest, P., et al. (1991). *Biotechnology (N Y)* 9: 266-71.
Tettelin, H., et al. (2002). *Proc Natl Acad Sci U S A* 99: 12391-6.
Tourdot, S., et al. (2000). *Eur* 1 Immunol 30: 3411-21.
Wiley, J., et al. (1987) Current Protocols in Molecular Biology.

SEQUENCE LISTING (514 sequences)

SEQ ID NO: 1 - DNA, 1287 bp, Streptococcus agalactiae
atgaagaaagttttaaccttcttattatgtagcttatattttgtatcaatcccagctataagtaccgaggagccattaacgctttctcaaaatagacgatacgccttaactcagacagttgtggataaggaaatgtattttgatgctattccagagagaccaactacaaaaattgaaataagcagttttcaagatgaagctttaaccataacaggagagactttagttccaaatactttattgtcgattgtttctcttacaattaattcaaatggaattccagtatttactttgtccaatggacagttcataaaggctagtcgtgaagctatttttaatgatttagtttctaagcagcaatctgtctcattggattattggttaaaaccttcttttgtgacttatgaagcaccttacacaaatggtgttagtgaagttaaaaataatttaaaaccttattccagagtgcatttagtagaacaagcagaaacagaacatggtatttattataaaacggacagtggtttttggatatcagtagaagatctatcggttgctgataatcgtatggctaaggttcaagaagtattattggaaaaatataataaagataaatatggtatatacatcaaacaattaaatacacagacagtagctggtattaatattgataggtcaatgtactctgcaagtattgcaaaattagcaacactttatgctagccaagagcaagtaaaattaggaaaactgtcattggacagcaaatttgaatacaaagataatgttaatcaatttcctaatagctatgatccaagtggtagtgggaaattagagaaaaaagctgatcataaattatataccgttaaggagttacttgaagcaactgccaaggaatcagataatgttgcaacaaatatgctaggttattatgtcaataatcaatatgattcaatgtttcaaacacaagtagacacaatttctggtatgcactgggatatgaaaaaacgccagatttctccacaagctgcgggtaaaatgatggaagcaatttattatcaaaatggagatattgttaattacctatcaaagactgattttgataatacaagaatccctaaaaatataccagttaaagtagcacataaaattggagatgcttatgactacaaacatgatgcggctattgtttatgcagaacaaccttttattatgattatctttacggataaatcatcttacgatgatatcactaagattgctgacgacgtttaccaggttttaaaataa

SEQ ID NO: 2 - DNA, 1344 bp, Streptococcus agalactiae
atgaaaaaaagaatattatcagcagtccttgtgagtggagtaactcttggaactgctgccgtaacagtaaacgctgatgactttgactcgaaaattgctgctactgattcagtaatcaatactttatcagggcaacaagcagcagcacaaaaccaggtgactgctattaaaggacaagttggtgctttagagtctcaacaatcagaattagaagcgcaaaatgctcaacttgaggctgtatctcagcagttaggtcaagagattcaaactctttctaataaaattgttgcacgtaacgaatctttgaaaaagcaagttcgtagtgctcaaaagggtaacttgactaactatattaatactattttaaattcgaaatcagtatctgatgctgttaatcgtgttgttgctattcgtgaggttgtttcagctaatgaaaagatgttagcacaacaagaggctgacaaagcggccttagaagctaaacaaattgaaaatcaaaatgctataaatactgtagcagctaacaagcaagctatcgaaaataataaagcagccttagcaacacaaagagcacaattagaagcagctcaattagagttatctgctcaattgactacagtccaaaatgaaaaagcatctttaattcaggcaaaagcacaagctgaggaagctgcgcgtaaggcagctgaagcacaagcagcagctgaagcgaaagcacaagctgaagcgaaagcacaagctgagtctgtagcaaaagcacaggcagcagcacaagttgagtctgccacagctcctactgaaacagttcaaacacaaccgagaactgaaataaagccttctaatcttacggctacttcttcggcaactactgttgctacaactacagctacagctactaatgagccaaaagttactcaaccttctgtagtaactaaagcagttgaagcacctaaagcagttgtttcttcaacacctagagcggtatcaaaacctgttgtcagaagttatgattcaagtaacacatacccaatgggacaatgtacttggggagctaagtcaatggcttcttgggttggtaactattggggaaatgctaatcagtggggtgctagtgcacgtgcagctggttattctgtaggaactacccctcgtgttggtgcagtagctgtttggccatatgatggtggtggttacgggcacgttgcagtagtaacgtcagtggctaacaattcatctatccaagttatggaatcaaactatgctggaaatatgagtattggcaattaccgtggttcatttaaccctagtgcttctggctctgtttactatatttacccaaattaa

SEQ ID NO: 3 - DNA, 3726 bp, Streptococcus agalactiae
atgaataaacgtatttttgttgagaaaaaggctgactttgacattaaatcggctagtcttgtgaaagagttgacgcataatctacaactgacttctttgaaggatttgcgtattgtgcaggtctatgatgtcttcaatttggctgaggatttgctggcgcgtgctgagaagcatattttctctgagcaggtgacagactgtcttttgacggaaactgaaatcactgcggagcttgataaggttgccttctttgccattgaggcgcttcctggtcaatttgaccaacgtgctgctagttcgcaagaatctttgctattgcttggaagtgacagtcaggttaaggtcaatacagcccagctttacttggtcaataaggatattgcagaagcagagcttgaagccgttaagaactatcttttgaatcctgttgattcacgtttcaaggacattaccttgccgcttgaagagcaggctttctctgtgtctgataagacaatccctagtcttgatttctttgaaacttataaggctgacgattttgcggcctataaggcagagcagggcttggctatggaggtcgatgatcttctcttcatccaagattatttcaaatcaatcgggcgtgtgccaactgagactgagttgaaagttttggatacttactggtcagaccactgccgtcacacaacctttgaaactgagttgaaaaacatcgacttttcagcttctaaattccaaaaacaattgcaggcgacttatgacaaatatatcgccatgcgtgatgaacttggtcgttctgaaaagccgcagacacttatggatatggcgactatctttggtcgttatgaacgtgccaatggacgactggatgatatggaagtctcagatgaaatcaatgcctgctcagttgaaattgaagtagatgttgatggtgtaaaagagccttggctcctcatgtttaagaatgagactcacaatcacccaacagaaattgagccatttggtggcgcagcaacttgtatcggtggtgccattcgtgacccgttgtcaggacgttcatacgtttatcaggctatgcgtatttcaggcgcaggcgatattacgactccgattgcggaaacacgtgctggtaaattgccgcaacaggttatttctaaaactgcggcgcacggctattcttcatatggtaaccagattgggcttgcgacaacttatgtgcgtgagtactttcaccctggctttgtagccaaacgcatggagcttggagctgtggttggtgctgcacctaaggaaaatgtggttcgtgaaaaaccagaagcaggcgatgtggtcatcttgctcggtggtaaaacaggtcgtgacggtgtcggcggtgcgacaggttcatctaaggttcaaacggttgaatctgtggaaacagctggcgcagaggtacaaaaagggaatgccatcgaagaacgtaagattcaacgccttttccgtaatggtaatgtcactcgcctaatcaagaaatcaaatgacttcggtgcaggtggtgtctgtgttgccatcggtgaattggctgacggtcttgaaatcgatttggacaaggtaccgcttaaataccaaggtcttaatggtactgaaattgcaatctcagaatcacaagagcgtatgtcagtcgttgttcgtcctagtgacgtggataccttcatcgcagcctgcaacaaggaaaatatcgatgccgttgtggttgctactattactgcaaaaccaaaccttgtcatgacttgggatggtgaaacaattgttgacttggaacgccgtttccttgataccaacggtgtccgtgtcgttgttgatgctaaagtcgttgacaaagacttgacagttccagaggtacgcacaacatcagcagagacacttgaagcggatacgcttaaggtcttgtctgacctcaaccacgctagtcaaaaaggtctccaaactatctttgactcatctgttggtcgctcaaccgttaaccacccaatcggtggccgttaccaaatcacaccaacagaaagctctgttcaaaaattgccagttcaacacggtgtcacaacaactgcatctgttatggctcaaggttacaatccttatattgcagaatggtcaccttaccacggtgctgcctatgctgtcattgaagcgacagctcgcttggtagcaacgggtgctgactggtctcgtgcacgtttctcttaccaagagtatttcgagcgtatggataaacaggcagagcgttttggtcagccagtatcagctcttcttggttctattgaggctcagattcaacttggattgccatcaatcggcggtaaggactctatgtctggtactttcgaagaattgacagtaccgccaaccttggtagctttcggtgtgacaacagcggacagccgcaaggttctctctcctgagtttaaagcggctggtgagaatatctactacattccaggtcaagctatttcagaagatattgattttgaccttatcaaggctaactttagccagttcgagactattcaagctcaacataagattactgctgcttcagctgttaaatacggtggtgtcctagaaagtcttgctctcatgacttttggtaaccgtatcggggcctctgttgaaattgcagagcttgacagtagcttgacagctcaactcggaggctttgtctttacatcagctgaggaaattgctgactcggtgaaaatcggtcaaactcaggcagcctttacacttactgtcaatggaaatgaccttgctggggcaagccttctatcagtcttcgaaggcaaattggaagaggtttacccaacagagtttgaacaggcagacgctcttgaagaagttcctgctgtggtatcagatactgttatcaaggctaaggaaacaattgaaaaaccagtggtttacattccagtcttccctggtaccaactcagaatatgattcagctaaggcctttgaacaggttggagctagtgtcaacttggtagcatttgtaaccttgaatgaggctgctattgctgactcagttgacacaatggtcgctaatattgctaaggcaaatatcatcttctttgctggaggattctcagcagcggatgaaccagatgggtctgctaagtttatcgtcaatatcttgcttaacaagaaggttcgcgcagctattgacagcttcatcgaaaaaggtggccttatcatcggtatctgtaatggtttccaagcccttgttaaatcaggtcttcttccatacggaaacttcgaggaagctggtgagacaagtccaaccctcttctataacgatgccaaccagcacgttgccaagatggttgagactcgtatcgcaaataccaactcaccttggttggtaggagttgaggtcggcgatattcatgccatcccagtttcacacggtgaaggtaaatttgttgtcagcgcttctgaatttgcagagctaagagacaatggtcaaatctggagccaatatgtggactttgacggacaaccatctatggattctaaatacaatccaaatggctctgtcaatgccatcgaagggattaccagcaagaatggtcaaatcatcggtaagatggggcactcagaacgctgggaagacggcctcttccaaaatatccctggtaacaaagaccaagccttgtttgctagtgcagtaaaatattttacaggaaaataa

SEQ ID NO: 4 - DNA, 1305 bp, Streptococcus agalactiae
atgaaaatgaataaaaaggtactattgacatcgacaatggcagcttcgctattatcagtcgcaagtgttcaagcacaagaaacagatacgacgtggacagcacgtactgtttcagaggtaaaggctgatttggtaaagcaagacaataaatcatcatatactgtgaaatatggtgatacactaagcgttatttcagaagcaatgtcaattgatatgaatgtcttagcaaaaataaataacattgcagatatcaatcttatttatcctgagacaacactgacagtaacttacgatcagaagagtcatactgccacttcaatgaaaatagaaacaccagcaacaaatgctgctggtcaaacaacagctactgtggatttgaaaaccaatcaagtttctgttgcagaccaaaaagtttctctcaatacaatttcggaaggtatgacaccagaagcagcaacaacgattgtttcgccaatgaagacatattcttctgcgccagctttgaaatcaaaagaagtattagcacaagagcaagctgttagtcaagcagcagctaatgaacaggtatcaccagctcctgtgaagtcgattacttcagaagttccagcagctaaagaggaagttaaaccaactcagacgtcagtcagtcagtcaacaacagtatcaccagcttctgttgccgctgaaacaccagctccagtagctaaagtagcaccggtaagaactgtagcagcccctagagtggcaagtgttaaagtagtcactcctaaagtagaaactggtgcatcaccagagcatgtatcagctccagcagttcctgtgactacgacttcaccagctacagacagtaagttacaagcgactgaagttaagagcgttccggtagcacaaaaagctccaacagcaacaccggtagcacaaccagcttcaacaacaaatgcagtagctgcacatcctgaaaatgcagggctccaacctcatgttgcagcttataaagaaaaagtagcgtcaacttatggagttaatgaattcagtacataccgtgcgggagatccaggtgatcatggtaaaggtttagcagttgactttattgtaggtactaatcaagcacttggtaataaagttgcacagtactctacacaaaatatggcagcaaataacatttcatatgttatctggcaacaaaagttttactcaaatacaaacagtatttatggacctgctaatacttggaatgcaatgccagatcgtggtggcgttactgccaaccactatgaccacgttcacgtatcatttaacaaataa

SEQ ID NO: 5 - DNA, 903 bp, Streptococcus agalactiae
atgttaaaacattttggtagtaaagtaagaaatttgagagtaactagaaatattactcgcgaagatttttgtggtgatgaaactgagttatctgtaagacaattagctaggattgaaagtggacagtcaattccaaacttgactaaagctcactacatagctaaacaattgaatgtaaaattggatattttaacaggaggagagagcttagaattacctaaacggtataaagagttgaagtacaaattgttgcgtaccccgacttacggagatgctaatagacttgcagttagagaagcatattttgatgaaatctatgaagtattttatgaggagctcccagaagatgaaagactaattattgattgtatgcaatcaaaattagatgttcatttttctgttaatgataattttggaatcactattttacatgactactttgatcaaattaagaaaaaaaaggaatataccacaaatgattttgttatgatagatttatatttactttgcttttctattaactatggaatgaagagcttgtattctttagagaactatcattttattatgtcaaaattgttagagcaagataatttacttcctgaggataattttcaattgaacaacgttttattaaatcatgtcgaattagcttttcaatttaagcagaaaaaatatgtacagcaaattattcatagaagtaatgctattatgacagaaatccatgattttcaaaaaagaccaatactaagcttaatagagtggaaatatttattaattattgaaaaagatagaacaaaagcagaaacatgttttaaacaatcaattctatttgcagagttaataggtgatctatatttaaaaggaaaattaatagaggagtggaataaagatttaacatga

SEQ ID NO: 6 - DNA, 2643 bp, Streptococcus agalactiae
atgactgaaaaaactaaagcggtagaaactacagatgttgctcttgcaattgatacattggttcaaaacggtttaaaagcacttgatgagatgcgtcaacttaatcaagaacaagttgattatattgtagctaaagcttctgttgcagccttggatgcccatggagaacttgctcttcatgcagtagaagaaactggtcgtggtgtctttgaagataaagcgacaaaaaatttatttgcatgtgaacacgtcgttaacaacatgcgtcatacaaagacagtgggagttattgaagaagacgatgtcacaggcttgacattaattgctgaaccagtgggagttgtctgtggtattacgccaacaaccaacccgacttcaactgctattttcaagtcattaatctctcttaaaacacgtaatccaattatttttgccttccacccatcagcacaagaatcatcagcacatgcagcacgtattgttcgtgatgctgctattgctgctggagctcctgaaaattgtgtccaatggattgaacaaccatcgattgatgcaactaatgctttgatgaaccatgatggtattgccactatccttgcgacaggtggtaatgcgatggttaaagctgcctactcatgtgggaaacctgcccttggtgtaggtgctgggaatgttccagcttatgttgaaaaatcagctaatatccgacaagccgctcacgatattgttatgtctaaatcatttgataacggtatggtatgtgcatcagaacaggctgttattattgataaagaaatttataaagaatttgttgaagaatttaaatcttatcatacttatttcgttaataagaaagaaaaagctcttcttgaagaattctgttttggtgcaaaagcaaatagcaaaaactgtgctggtgcaaaattaaatccaaatattgttggaaaatcagcagtttggattgctgaacaagctggatttactgttccagaaggaacaaatattcttgccgcagaatgtactgaagttagtgaaaaagaacctttgacacgtgaaaaactatcacctgttattgccgtattgaaagctgaatctacagaagatggtgttgaaaaagctcgtcaaatggttgagtttaatggtctaggacactcagctgctattcatacaaaagatgcagacttagctcgtgaatttggaactagaattcgtgctatccgtgttatttggaattctccttctacttttggtggtattggggatgtttacaatgctttcttgccatcattgactcttggttgtggttcgtatggacgtaactcagttggtgataacgttagtgctataaatctcttgaatatcaaaaaagtaggaagacgtagaaataatatgcaatggtttaaagtcccttcaaaaacatacttcgaacgtgattctattcaatatttgcaaaaatgtcgcgatgttgaacgtgtcatgattgttacagatcacgccatggttgagcttggtttcttggatcgtatcattgaacaacttgatcttcgtcgcaataaagttgtttatcagatttttgctgaagtagaaccagatccagacattacaacagtaatgaaaggaacagatttgatgcgtaccttcaaaccagacactattattgcattaggtggtggttctcctatggatgctgcgaaagttatgtggctcttctatgaacaaccagaagttgatttccatgacctcgttcaaaaattcatggatatccgtaaacgtgcgttcaaattcccagaacttggtaagaaaacaaaatttgttgctattccaacaacttctggaacaggttctgaagtgacaccatttgccgttatctctgacaaagcaaataatcgtaaatatccaatcgctgattattcattaacaccaactgtagctatcgttgatccggcccttgttatgactgttcctggttttattgcggctgatacgggtatggatgtattgacacatgcaacagaggcttatgtttcacagatggcaaatgattatacagacggacttgcccttcaagcaattaaaattgtgtttgactacttagaacgctcagtaaaagatgctgattttgaagcacgtgaaaagatgcacaatgcgtcaactatggcaggtatggctttcgccaatgcattcttaggtatttctcactcaatggcgcataaaattggcgcacaattccataccgtacacggacgtacaaatgcaattcttttgccgtatgttatccgctataatggaactcgtccagctaaaacagcaacatggcctaagtacaattactatcgtgctgatgaaaaatatcaagatatcgctaaattactcggcttaccagcagcaacaccagaagaagctgtcgaatcatatgcaaaagctgtgtatgaccttggaacacgtttaggtattaagatgaatttccgcgaccaaggcattgatgaaaaagaatggaaagaaaaatctcgtgaactagctttcttagcatatgaagatcaatgttcaccagcaaatccacgccttccgatggtagatcacatgcaagaaatcatcgaagatgcttattatggttatgaggaacgtccaggacgtcgtaagtaa

SEQ ID NO: 7 - DNA, 834 bp, Streptococcus agalactiae
gtgggtattaaagtttataaaccaacgacaaatggccgtcgtaatatgacttctttggattttgcagaaatcactacaaacactcctgagaaatcattgcttgtttcactaaagaataaagcaggacgtaacaacaacggacgtattactgttcgtcaccaaggtggtggacacaaacgtcattaccgtttgattgacttcaaacgtaataaagatggtgttgaagcagttgttaaaacaattgaatacgatccaaatcgtactgcaaatattgctcttgtacactatactgatggtgttaaagcttacattcttgcgcctaaaggccttgaagtaggtcaacgcattatttctggtccagaagcagatatcaaagttggtaacgcacttccacttgctaacattccagtcggtacagttatccataatattgaattgcaaccaggtaaaggtgctgaattgattcgtgccgcgggtgcttctgctcaagtacttggtcaagaaggtaaatatgttcttgttcgccttcaatcaggtgaagtacgtatgatccttggtacttgccgtgcaacaattggtactgttggtaatgaacaacaatcacttgttaacattggtaaagcaggacgtaatcgttggaaaggtgttcgccctacagttcgtggttctgtaatgaaccctaatgatcacccacacggtggtggtgaaggtaaagcaccagttggtcgtaaagcaccatctactccatggggtaaacctgcacttggacttaaaactcgtaataagaaagctaaatcagacaaacttattgttcgtcgtcgtaaccaaaaataa

SEQ ID NO: 8 - DNA, 939 bp, Streptococcus agalactiae
atgattgagtttgaaaaaccaataataacaaaaattgatgaaaataaagattacggcagatttgtcatcgaaccactagaacgtggctacggtacaactctaggaaactctcttcgtcgtgtgcttctgtcttcacttccaggtgcagcagtcacatcaatcaaaattgatggagtattacacgaatttgatactatcccaggtgtacgtgaagatgtgatgcaaatcatccttaatgtaaaaggacttgctgtgaaatcttacgtcgaagacgaaaagattatcgaactagacgttgaaggtcctgcagaaattactgccggagatattttaacagatagtgatatcgaaattgtaaaccctgaccattatcttttcacaattgctgaaggtcacagtttgaaagcaacaatgacagttgctaaaaaccgaggttatgttccagcagaaggaaataaaaaagatgatgcaccagtgggaacattggctgtagattcaatctatacaccagtgaaaaaagttaattatcaagttgaacctgctcgtgtaggtagtaacgatggctttgataaattaactattgaaatcatgacaaatggcacaatcattcctgaggatgctcttggtctttcagctcgcgtcttaattgaacacttaaacttgtttactgatttaacagaggttgctaaagcaactgaagtaatgaaggaaacagagaaagtgaacgatgagaaagtgcttgaccgcacaattgaggaacttgatttgtcagtgcgctcatataactgtttaaaacgtgctggaattaatacagtatttgatttaacagaaaaaactgagcctgaaatgatgaaagtccgaaacttaggacgtaagagtcttgaagaagttaaaatcaaacttgccgatctaggtcttggattaaaaaacgataaataa

SEQ ID NO: 9 - DNA, 927 bp, Streptococcus agalactiae
atgaaaaagattcgattatcaaagtttattaaaatgattgttgttattttgtttttaattagtgtagcagctagtttttattttttccacgttgcccaagttcgagatgataaatcctttatttcaaatggtcaacgtaagcctggaaactctttatatgcttatgataaatcctttgataagctattaaagcaaaaaatagaaatgacaaaccaaaatataaagcaagttgcttggtatgttcctgctgctaagaaaactcataagacagctgttgtcgttcatggttttgcgaatagcaaagagaatatgaaggcatatggttggctgtttcataagttaggatacaatgttcttatgcctgacaatattgcacatggtgaaagtcatgggcagttgataggctatggctggaacgaccgcgagaacattatcaaatggacagaaatgatagttgataagaatccatcaagccaaattactttatttggtgtttcaatgggtggagcaacagtcatgatggctagtggtgaaaaattacctagtcaggttgttaatatcattgaagattgcggttattctagtgtttgggatgaattaaaatttcaggctaaagagatgtatggtttaccagccttcccactcttatatgaagtttcaacaatttctaaaatcagagcaggtttttcgtatggacaagcaagtagtgtcgaacaattgaaaaagaataatttaccagccctctttattcatggtgataaggataattttgttccaacaagtatggtttatgacaactataaagctacagcaggtaagaaagagctttatattgtaaaaggggcaaaacatgcgaaatcttttgaaacagagccagaaaaatatgagaaacgtatctctagttttttgaaaaaatatgaaaaataa

SEQ ID NO: 10 - DNA, 447 bp, Streptococcus agalactiae
atgtcaaaagtacgtggctttgaattagttagccaatttagcaataaagagttattaccaaaacgagaaacagctcacgcagctggctatgatttaaaagtagctaaaaaaacggttattgaacctggtgaaattacattggtcccgaccggtattaaagcacacatgcaaccaggggaggtcctgtacctttatgatcgttcatcgaatccacgtaaaaaagggattgtcctaataaattcagttggtgttattgatggtgactactataataaccaagtcaatgaaggacatatttttgcacagatgcaaaatattactgatcaggctgttattttagaagaaggggaacggattgttcaggctgtttttgccccattcttattggcagatgacgatcaggctacaggaatgcgtacaggtggttttggtagtactggaaaataa

SEQ ID NO: 11 - DNA, 969 bp, Streptococcus agalactiae
atgaaatttggaaaaaaacttggctttctagccttattgatgtctattgtcctcattctaggtgcatgtggtaaaactggacttggaaattctactgggaattctacaaaaaatgtaaccaaaaaatctgctaaaaacttgaaactaggtgtatctatttcaacaactaacaatccctactttgttgcgatgaaagacggtattgacaaatatgctagcaataaaaaaataagcattaaggtagctgatgctcaagatgacgccgcacgtcaagcagatgatgtccaaaactttattagtcaaaacgtagatgctattttgattaatcccgttgactcaaaagctattgtaacagctattaagtctgcaaacaacgctaatattcctgttattctaatggaccgtggtagtgagggaggcaaagtattaactactgtcgcttcagataacgttgctgctggtaagatggctgcggattatgctgttaaaaaactaggcaaaaaagcaaaagcctttgaattatctggagtaccaggtgcctctgctactgtagaccgtggtaaaggatttcattcagttgcaaaatctaaacttgacattctttcaagccaatctgccaattttgaccgcgccaaagctttgaatactacacaaaatatgattcaaggacataaagatgtccaaattattttcgcacaaaatgatgaaatggcacttggggctgcacaggctgtcaaatctgctggcttgcaaaatgttcttatcgtaggaattgatggtcagccagatgcccatgatgccattaaaaaaggagatatttcagccactattgcacaacaaccagctaagatgggagaaatagcaattcaagcagcaattgatcattataaaggcaaaaaagtagagaaagaaacaatttctccaatttaccttgttaccaaagacaatgttgaaaaatacaattggtaa

SEQ ID NO: 12 - DNA, 1191 bp, Streptococcus agalactiae
atgggaaaagaaaaattaattttagcttattctggtggtttagatacctctgttgctatagcttggttaaaaaaagattatgacgttattgctgtctgtatggatgttggcgaaggtaaagatcttgattttattcacgataaggctttaacaataggtgccatagaatcttatattttagatgttaaagatgagttcgctgagcattttgtgttaccagctttacaggcacatgcgatgtatgaacaaaaatacccgcttgtttcagcgcttagtcgtccaattattgctcaaaaattagttgaaatggcacatcaaacaggtgcgaccacaattgcccatggatgtacaggtaaaggaaatgaccaagtgcgttttgaagttgcaattgcagcactagatcctgaattaaaagtaattgcccctgttcgtgagtggaagtggcatcgtgaagaggaaattacttttgcaaaagctaacggcgtacctattccagcagatttagataacccttattctatagaccaaaatttatggggacgtgccaatgaatgtggtgtgcttgagaatccttggaatcaagcgccagaagaagcttttggtattacaaaatcaccagaagaagctcctgattgtgcagaatatattgatattacgttccaaaatgggaagcctatagctataaacaatcaagaaatgacactagcagatttgattttatcgctaaatgaaattgcaggaaaacatggtattggacgcattgatcatgttgaaaatcgtttagtcggtatcaaatcacgtgaaatttatgaatgtcctgcggcaatggtactgttagctgctcataaagaaattgaagatttaacattagtccgtgaagtgtctcattttaaacctatccttgaaaatgaactatcaaatcttatttataatgctttatggtttagtccagctacaaaagctatcattgcctatgtcaaagaaacacaaaaagtggttaatggtactacaaaagttaagttatataaaggttctgccaaagtcgttgctcgccactcgtctaattcattatatgatgagaacttagcaacttatacagctgctgataactttgatcaagatgcagcagttggttttatcaaactctggggacttccaacccaagttaatgcacaagtaaacaaaggataa

SEQ ID NO: 13 - DNA, 189 bp, Streptococcus agalactiae
atggctaaagtatgttatttcacaggacgtaaaacagtttctggtaacaaccgttcacacgcgatgaaccaaacaaaacgtactgttaaaccaaaccttcaaaaagttactgttcttatcgacggtaaaccaaaaaaagtttgggtttcagctcgtgcgcttaaatctggtaaagtagaacgcgtttaa

SEQ ID NO: 14 - DNA, 1656 bp, Streptococcus agalactiae
atggcaaaacagaaaaataactggcgccgtgttggagttggtgtccttacacttgcttcagttgcgactcttgctgcatgtggaagtaaatcagcttcccaggattctaatggagcgattaattgggctattccaacagaaatcaatacactagatttatctaaagttacagacacttactcaaatctagctattggtaactctagtagtaatttccttcgcttagataaggatggaaagacgagaccagatttggctactaaagttgatgtttcaaaagatggtttaacttatacagctacattacgtaaaggcttgaagtggtcagatggcagtaaacttactgcaaaggattttgtttattcatggcaacgtttagttgatcctaagacagcttcacaatatgcttaccttgctgttgaagggcatgtgcttaatgccgataaaatcaacgaaggacaagagaaagacttgaataagctaggtgttaaggcagaaggcgatgacaaagttgttattactttatctagtccgtctccacaattcatctactaccttgcattcactaatttcatgccacaaaaacaagaagttgttgaaaaatatggaaaagattacgcaactacttcaaaaaatacagtttactcaggaccatatactgttgaaggttggaatggttcaaatggtactttcaccctgaagaaaaacaaaaattattgggacgctaaaaatgtaaaaacaaaagaagttcgcatccagactgttaaaaaaccagataccgccgttcaaatgtataaacgtggtgaattagatgcagctaatatctcaaatacttctgctatttatcaagctaataaaaataataaagatgtcacagatgttctagaagcgaccactgcctatatgcaatataatactactggttctgtgaaagggcttgataatgttaagattcgtcgcgccttaaacttagcaactaaccgtaaaggagttgttcaagcagccgttgatacaggctcaaaaccggcaattgcttttgcaccgactggtttagccaaaacaccagatggaactgatttggcaaaatatgttgccccaggttatgaatataataaaactgaagcagcaaaactctttaaagaaggtttggctgaatcaggcttgactaagctaaaattaacaattacagcagatgctgatgttcctgctgccaaaaactctgttgactatatcaagtctacttgggaagctgctcttccaggacttactgttgaagaaaaatttgtaacctttaaacaacgcttagaagacagtagaaaacaaaactttgatatcgtagtttctgtttggggtggggattatccagaagggtcaactttctacggcctctttaagtcagattcacaaaataacgatggaaaatttgctaacaaggactatgacgctgcttataacaaggcaatttccgaagatgccttaaaaccagaagaatcagcaaaggactataaagaagcagagaaaattctatttgagcaaggcgcttataacccactctacttccgtagtggtaaaggtttacaaaatccaaaattaaaaggtgttattcgtaatactacaggtttgtcaatagactttacacatgcttataaaaaataa

SEQ ID NO: 15 - DNA, 729 bp, Streptococcus agalactiae
atggaactcttaaaaacacccatctttggtatttgcttttctttaatactctatacgataggacaacatttatttaagaagagtaaaggtttcttccttttgcagcctcttttctttgcaatggttagtggtattgtcattctttggcttatgtcaaaaggtttaggaaccgatgttaagacattttatacacaagcttataaaccaggtggcgatttaatattttggtttttaaatccagcaacaattgcttttgcagttcctctctataagaaaaatgacgttgttaaaaaatattgggtagaaattctcagcagtttagtaatcggtatgattgtttcccttatgcttatcgtcgctatttctaaaatggttgggcttagtcaagtcggaattgcttcaatgttgccacaagcagcaacaacagcaattgctcttccaataacagcagcaattggagggaacacagctgtgacagcaatggcgtgtatcttaaatgcagttattatttatgcattaggtaaaaaattagtgtcatttttccatttgaatgatagtaagattggtgcaggattaggtctagggacctctggtcatacagtcggagcagcctttgcattggaattgggagaactgcaaggtgcgatggcagctatagcggtggtggttatcggtttggtagttgatttggttattcctatctttagtcatttgattggtttgctataa

SEQ ID NO: 16 - DNA, 1629 bp, Streptococcus agalactiae
gtgactaaatatttgaagtacatctcttttgttgctttgtttctggcgagtatctttttagtagcttgtcaaaatcaaaattcacaaacaaaggagcgaacacgaaaacaacgacccaaagatgaattggttgtttctatgggggcaaagcttcctcatgaattcgatccaaaggaccgttatggaatccataatgaaggtaatattactcatagtaccctattgaaacgttctcctgaactagatataaaaggagagcttgctaaaaaatataaaatctctaaggatggcttaacgtggtcgttcgacttaaatgatgattttaaattctccaatggtgagcctgttactgctgacgatgttaagtttacttatgatatgttgaaagcagatggaaaagcttgggatttgacctttattaagaatgttgaagtagttgggaaaaaccaggtaaatattcatttgactgaggcgcattcgacatttacagcacagttgacagaaatcccaatcgtccctaaaaaacattacaatgataagtataagagcaatcctatcggttcaggaccttacatggtaaaagaatataaggctggagaacaagcaatcttcgttcgaaatccatattggcacggtaaaaagccttattttaaaaagtggacttgggtattacttgatgaaaatacagcactagctgctttagaatctggtgatgttgacatgatttacgcaacgccagagcttgctagcaagaaagtcaaaggaacacgtcttctagatattgcttcaaatgatgttcgtgggttatcgctaccttatgtgaagaaaggtgttgtgaaaaattcaccagacggttatccagtaggaaatgatgtcactagtgatccagcaatcagaaaagccttgactattggtttaaatagacaaaaagttctggatactgttttaaatggttatggtaaaccagcttattcaattattgatagaacaccattctggaatccaaaaacagcaattaaagataataaagtagctaaagctaagcaacttttgacaaaagctggatggaaagaacaagcagacggtagccgcaaaaaaggaaatcttaaagcggaatttgacctttactaccctactaatgatcaattacgagcaaacttagccgttgaagtagcggagcaagctaaagccttaggtattactattaaactcaaggctagtaactgggatgaaatggcaactaagtcacatgattcagccttactttatgcgggaggacgtcatcatgcgcagcaattttatgaatcacattacccaagtttagctggtaaaggttggaccaatattactttttataacaatcctactgtgactaagtaccttgacaaagcaatgacatctcccgaccttgataaagctaacaaatattggaagttagctcagtgggatggcaaaacaggtgcttccactcttggagatttaccaaatgtatggttggtgagtcttaaccatacttatattggtgataaacgtatcaatgtaggtaaacaaggtgtccatagtcatggtcatgattggtcattattgactaacattgctgaatggacttgggatgaatctgctaagtaa

SEQ ID NO: 17 - DNA, 1146 bp, Streptococcus agalactiae
atgggccaagaacctatcatcgaatatcaaaatatcaataaagtgtatggggaaaatgttgcggttgaagatattaaccttaaaatttaccctggtgatttcgtttgtttcatcggtacgagtggatcaggtaaaacaacattaatgcgtatggttaaccatatgttaaaaccaacaaatggtactctattatttaagggaaaagatatttctactattaaccccattgaattaagacgcagaattggatatgttatccaaaacattggtttaatgcctcatatgaccatttacgaaaatatagttcttgtaccaaaattattgaaatggtcagaagaagctaaaagagctaaagcaagggaacttattaaattagttgaattacccgaagaatatttggatcgctaccctagtgagttgtctggcggtcagcaacaacgtatcggtgtcattcgcgctcttgcagcagaccaagatattattttaatggatgagccttttggagctctggatcctattactagagaaggtattcaagacttagtcaagtctcttcaggaagaaatggggaaaactatcatcttagttactcatgatatggatgaagccctcaagttagcaacaaaaattattgttatggacaatggtaaaatggtccaagaagggacacccaatgatctcttacatcatcctgctaccagtttcgttgaacaaatgattggggaagagcgtcttcttcatgcgcaggctgatattacccctgttaaacagataatgttaaataatcctgtttcaataactgctgaaaaaacactaactgaagctattacactaatgcgccaaaaacgcgttgactcacttctagtaaccgataacggtaaattaattggttttattgacttagaatctctaagcagtaaatataagaaagaccgacttgtttctgatatcttaaaacatactgatttttatgttatggaagacgacttacttagaaatactgctgagcgtattttaaaacgtggtttaaaatacgctccagttgttgaccatgagaataacctaaagggcattgttactcgtgcatccctagttgatatgttatacgatattatttggggcgatactgaaacggaggatcaataa

SEQ ID NO: 18 - DNA, 708 bp, Streptococcus agalactiae
atgaaaatagataaaaaagaatttttagcacttattgctagtattattttattaatttttgcttctgttacgtttttcttatttaaagatcatggcactactcaaatggatactgtagaaagcagtgttaaccatgtcagtgattctcaattaactgaggcacaagatatgttagataaatttgagaagaaaccttcagaaaaattattgaaggatgtcgaacttgctttaaataaattgtccaattcttctaaaaaagaagctttgcaaaaacgttttaagaaagcaaaagataagtatcttaaagacgaagcagataagaaagctaccaaagatgctacagatttagtagaaattctagaacaagccccttcagaagaaaatgtgttaaaagctgaagcagcagtcaataagttaactgtcaaagaatctaaagaagctttacaaaaacgtattgatactgttaagacacaatatggtttgattgggaatcaaactccctctagttcagtagctgaaactacagaacaagggacagctaatcctgctagtcaggatacttctagttacgttaatcagaatgtagcaccaacttatgagcaaccgcaaacgaataatacaccagttactccaggggttaacaatactgttccgactccaggaactggtactgcacctgctactaatgggacgggtgttgctcagtaa

SEQ ID NO: 19 - DNA, 2040 bp, Streptococcus agalactiae
atgactaaagatttattattggagcttggccttgaagagttgccagcttatgttgtgacaccgagtgagaagcaattgggccaaaaaatggtcaagtttttagaggatcatcgtttatcatttgaaactgttcaaactttttcaactccacgtcgtttggctgttcgtgttaaaggattggcagaccagcagacagatttaacagaagatttcaagggtccttctaagaaaattgctttggatgcagaagggaatttttctaaagcagcccaaggttttgttcgcggaaaaggtttaagtgttgatgatatcgaatttcgtgaagttaagggagaagaatatgtttatgtcactaagcatgaaactggaaaaagtgcgattgatgttttagcaagtgtgacagaggtattaacagaattgactttcccagtgaacatgcattgggcaaataatagttttgaatatattcgtccagttcacactttagtggtattattagatgatcaagccttagagctagacttccttgatattcattcagggcgtattagtcgagggcaccgtttcttgggttctgacactgaaattttatctgctagttcgtatgaagatgacttgcgacaacaatttgttattgctgatgcaaaagaacgccagcaaatgatcgttgatcaaattcatgctatcgaagaaaaggaaaatatttcagttgaaattgacgaagatttactaaatgaagtgcttaatttagttgagtatccgacagcattcttgggttcttttgacgagaaataccttgatgtacctgaagaagttttagtcacttcaatgaaaaatcatcaacgctattttgttgttcgcgacagggatggaaaattgttaccaaactttatttctgtgcgtaatggaaatgctgagcatatcgaaaatgttataaaaggtaatgaaaaagttttagtggctcgtctcgaagatggtgaattcttctggcaagaagatcagaaacttaatattgcagatttagttgagaaattaaaacaagtaactttccatgaaaaaattggttcactttatgaacatatggatcgtgtaaaagttatttcacaatatttggctgagaaggcagatctttctgatgaagaaaaattagctgtgcttcgagctgcaagtatttataaatttgacctcttaactggaatggttgatgagtttgatgaattacaaggtattatgggtgagaaatatgccttacttgcaggggaacagcccgcagtagcagcagcgatacgtgaacattatatgccgacatcggccgatggagagcttccagaaaccagagttggtgcaattctagcgttagctgataaatttgacaccttactttcattcttctcagttggtttgattccaagcggttcaaatgatccatatgctcttcgtcgagctactcaggggattgtccgtattttggaagcttttggttgggatatcccacttgatgaattagtaactaacctttatggtctatcgtttgctagtttagattatgctaatcaaaaagaggtcatggcctttatttcagctcgtattgaaaagatgattggctctaaggtccctaaagatattcgagaagccgttttagaatcagacacttatattgttagccttattctagaagctagccaagcattggtgcaaaagagcaaggatgctcaatataaagtttccattgaaagtttgtcacgtgcatttaatttagctgaaaaagttactcattctgtatcggtggactattcattgtttgaaaataatcaggagaaggcgctatatcaagctattttgtcacttgaactgactgaggatatgcatgacaacttagataagcttttcgcacttagtccaattattaatgatttctttgataatacaatggtaatgacagatgatgaaaaaatgaaacaaaatcgtctggctttactcaatagccttgttgcaaaagcaagaacagtcgctgcttttaacttattaaacacaaaataa

SEQ ID NO: 20 - DNA, 1986 bp, Streptococcus agalactiae
atgacatttgacaccattgatcaattagcggttaatacagtccgcacgctttctattgatgctatccaagcagcaaattctgggcacccaggtcttcctatgggagctgcgcctatggcttatgtgctttggaataaattcttaaatgtaaacccaaaaacaagtcgcaattggacaaaccgtgaccgttttgtgctatcagctgggcatggttcagctcttctttatagcctacttcatttagctggctatgatttatcaattgatgatttaaaacaattccgccaatggggatcaaaaacacctggacatccagaagttaaccatactgatggtgtagaagcaacaactggacctttagggcaaggtattgctaatgctgttggtatggcaatggctgaagctcatttggctgctaaatttaataaaccaggctttgatttagttgatcattacacttatacacttcatggtgatggttgtttgatggagggtgttagccaagaagctgccagtcttgctggacacttaaaacttggtaaattggtccttctttatgattcaaatgatatctcacttgatggtccaacgtctcaatcatttacagaagatgttaaagggcgttttgaatcatatggttggcaacatatcttagttaaagatggtaatgatttagaagcgattgctgcagcaattgaagctgctaaagctgaaactgataaaccaaccattattgaagttaaaactattattggatttggcgcagagaaacagggaacatcttcagttcatggagcgccacttggtgcagaaggtattacttttgccaagaaggcttatggatgggaatatccagactttactgttcctgctgaagttgtagctcgatttgcctcagatcttcaagcgcgtggtgcgaaggcagaagaggcatggaatgatctttttgctaaatatgaagttgagtatccagaattagcagctgaatacaaagaagcttttgctggccaagctgagacagttgaattgaaagctcatgacctaggttcatcagtggctagtcgtgtttcaagccaacaagctattcaacaattatcgactcaattaccgaacctctggggagggtcagcagacctctcagcttctaataacacaatggtagcagcagaaacagatttccaagcaagtaattacgctgggcgtaacatttggtttggtgtacgtgaatttgcaatggctgctgcaatgaatggaattgcgcttcacggtgggactcgtgtttatgggggtacattctttgtcttctcaaactacttgttaccagcagtacgtatggctgcacttcaaaacttgccaactgtctatgttatgacacatgattctattgctgttggagaagatgggccaactcatgagccaatagaacaattagcatcagtgcgctcaatgcctaatttgaacgttatccgtcccgcagacggtaatgaaacaaacgctgcatggcaacgagctgtatcagagacagatcgaccaacgatgcttgttttaacacgtcaaaacttaccagttcttgaaggaacatcagaattagcccaagaaggggttaataaaggtgcttatattttatcagaagctaaaggtgaacttgatggtatcatcattgcaacaggttcagaagttaaattagctttagatactcaagacaaacttgagtcagagggcatccatgttcgcgtcgtatctatgccagcacaaaacatttttgatgaacaagaggcttcatatcaagagcaagtgcttccatcagctgttacaaaacgtcttgctattgaggcaggatcaagcttcggttggggtaaatatgttggtttaaatgggctaacacttactattgatacttggggagcatcagcaccaggtaacagaattttcgaagagtatggctttacagttgagaatgctgtatcgctatataaagaactttaa

SEQ ID NO: 21 - DNA, 822 bp, Streptococcus agalactiae
atgactttgcaagatcaaattatcaaagaactcggtgtaaaacctgttattaatccaagtcaagaaatccgtcgttccgtagaatttttaaaagactatctattaaaacatagttttctaaagacctatgtactgggtatttcaggggggcaagattcaactttagcaggacgtctagctcaactagcagttgaagagttgcgtgctgatacaggggaaaactatcaatttatagctattcgtttaccatatggtattcaggccgatgaagaagatgcacaaaaagcattagattttatcaagccagatattgctttgaccattaatattaaagaagctgttgatggccaagttagagctcttaatgcagcaggagtagagattacagactttaataaaggaaatattaaagctcgtcaaagaatgattagtcaatatgcagttgcaggtcaatatgctggagcggttattggtactgatcatgctgcagaaaatattacaggttttttcaccaaatttggtgatggaggtgctgacttattacctctctttagacttaataaaagtcaggggaaacagttattagctgaacttggtgctgataaagccttgtacgaaaagattccaaccgcagatttagaagaaaataaaccaggaatcgctgatgaaatagcccttggagtaacctaccaagaaattgatgcttatcttgaagggaaggtggtttcggacaagtctcgaggtatcattgaaaattggtggtataagggtcaacataaacgtcatcttccaatcacaatttttgatgatttctggaaataa

SEQ ID NO: 22 - DNA, 2238 bp, Streptococcus agalactiae
attaaaaaggaatctgttatcaaactattgaagtatgcttttggcattataatgggatttattatcttagctattgtaataggtgggctcctatttgcatactacgttagtcgttctccgaaattaaccgatcaagctttaaaatccgttaactctagtttggtttatgatggtaataataaacttattgccgatttaggctcagaaaagcgtgaaagtgttagtgcggatagcattccactaaatttggttaacgctatcacttctatcgaagataaacgtttctttaaacatagaggtgtcgatatttatcgtattttaggtgcagcttggcataatcttgttagtagtaatacgcaaggtggttcaacccttgatcaacagttgattaaactggcttacttttctaccaataaatctgaccaaacgttaaaacgtaaatcacaggaagtttggcttgcgcttcaaatggagcgtaaatacaccaaagaagaaattcttactttctatattaataaagtttatatgggaaatgggaattatggtatgagaacaacagctaaatcatactttggtaaagacctaaaggaattatctattgcacaacttgctttgctcgctggtattcctcaagcacctacacaatatgacccttataaaaacccagaatctgctcaaacaagacgtaataccgttcttcagcagatgtatcaagataaaaacatttctaaaaaggaatacgaccaagctgttgcaactccagtaactgatggcttaaaagaattaaagcaaaaatctacttatccaaaatatatggataactacttaaaacaagttattagtgaagttaaacaaaaaactggtaaagatatctttactgctgggctaaaagtgtatactaatatcaacactgatgcacaaaaacaactatatgacatctacaacagtgacacttacatcgcttatccaaacaatgaattacaaatagcatctaccatcatggatgcgactaatggtaaagtcattgcacaattaggcgggcgtcatcagaatgaaaatatttcatttgggacaaatcaatctgtcttaacagaccgcgattggggttctacaatgaaacctatctcagcttatgcacctgctattgatagtggtgtctataattcaacaggtcaatcattaaacgactcagtttactactggcctggtacttctactcaactatatgactgggatcgtcaatatatgggttggatgagtatgcagaccgctattcaacaatcacgtaacgtccctgctgtcagagcacttgaagccgctggattagacgaagcaaaatctttccttgaaaaattaggcatatactatccagaaatgaactattcaaatgctatttcaagtaacaacagtagcagtgatgcaaaatatggtgcaagtagtgagaaaatggcagcggcttactcggcttttgcaaacggcggaacttactataaaccgcaatatgttaataaaattgaatttagcgatggaaccaatgatacttatgcagcgtctggtagccgtgcgatgaaagagactactgcctacatgatgacggatatgctgaaaacagtactaacatttggtactggtactaaagcagctatccctggtgttgcacaagctggtaagactggtacttccaactatacggaagatgagttagctaaaattgaagcaactactggtatctacaatagcgccgttggtacaatggctcctgatgaaaactttgtcggctatacttctaagtacacaatggcaatttggactggttataaaaatcgccttacaccactttatggtagccaactggatattgctactgaggtttatcgtgcaatgatgtcctacctaactggcggatacagtgcagattggacaatgccagaagggctctatcgaagcggaagctacttgtatatcaatgggacaactacaaccggcacttactcttcttctgtctataagaatatctatcaaaattctggacagtcaagtcaaagcagtagttcaacatcctctgagaaacaaaaagaggataagaatacagcaaatgatgccaattcatcatccccacaagtcgaaacacctaataatggtaatgctactacccctaataattccaatcaaactgtgccaggaactggacatggtaatggtaatggtaacaacaatacagtacctaacggtaattaa

SEQ ID NO: 23 - DNA, 1278 bp, Streptococcus agalactiae
atgttagacttaaaacgtattcgtacagattttgatgttgtcgctaaaaaattggccacgcgtggtgttgaccaagaaacattaacaacccttaaagaacttgatataaaacgccgtgaactacttatcaaagctgaagaggcgaaagcgcaacgtaatgttgcttctgctgccattgctcaagcaaaacgaaataaagagaatgcagacgagcaaatcgcagctatgcaaacactttccgctgatatcaaagcaattgatgcggaattggcagatgtggatgctaatttacaatcaatggtgaccgtacttcctaatacaccagctgatgatgtgccgcttggagcagacgaggatgaaaatgttgaagttcgtcgctggggaactcctcgtgaatttgattttgagaccaaagctcactgggatttaggtgaaagccttggaattctcgattgggaacgtggtgcaaaagttactggctctcgcttcctcttctacaaaggtctaggtgctcgtttagagcgtgctatctacagcttcatgctggatgaacacgctaaggaggggtacactgaagtgatccctccttatatggttaaccacgattcaatgttcggtacgggacaatatccaaagttcaaggaagatactttcgaattagcagatagcccattcgtacttatcccaacagctgaagttcctttaacaaactattatcgtgatgaaattatcgatgggaaagaattacctatatactttactgccatgagtccatcattccgttcagaagcaggctctgcaggacgtgacacacgtggattaattcgccttcatcaattccataaagtagaaatggtgaaatttgccaagcctgaggaatcataccaagaattagaaaaaatgacagcaaatgctgaaaatattcttcaaaaacttaatctcccataccgtgtcattaccttgtgtacaggagatatgggattctcagcagctaaaacgtatgacttagaggtatggattcccgctcaaaatacttatcgagaaatttcttcatgttctaatactgaagatttccaagcacgtcgtgctcaaattcgttaccgtgacgaagttgatggcaaagttaggttgcttcatactttaaatggttcaggacttgcagttggacgtactgtagcagcaatcctcgaaaattatcaaaatgaagatggttctgtgactatcccagaagttcttcgtccatatatgggtaatatcgatattattaaaccaaattag

SEQ ID NO: 24 - DNA, 801 bp, Streptococcus agalactiae
gtgacaatatcaaatcaagaattgacgcttactcccttaagaggaaaaagtggcaaagcctatattggtacttatccaaatggtgaacgtgtctttgtcaaatataatacgacacctattttgccagccttagctaaggaacagattgcgccacaactactgtgggcacgccgtacaagtaatggcgatatgatgagtgctcaagaatggttagatggtcgaacattgactaaagaagatatgggtagtaaacagattattcatattttattgcgcctgcacaagtctcgtcccttagtaaatcagctgttacaattagggtataaaattgaaaacccttatgatttgttgatggattgggaaaaacaaactcctattcaaatccgggaaaacacttatttgcaatctattgtgactgagttaaagcgtagtttacctgagtttcgaacagaggttgcaacaatcgttcacggagatatcaaacatagcaactgggttattacaacaagtggtttaatttatttggttgattgggattctgttcgtttaacagatcgcatgtatgacgttgcatatattttaagtcattatattccacaaaaacactggaaagattggctgtcttactacggttataaagataatgagaaagtctggagcaaaattatctggtatgggcaattttcatatttatcacagataatcaaatgttttgataaacgagatatggagcatgtcaatcaagaaatttatgaattacgaaagtttagagagttaattaaaaagcataatgcgagttag

SEQ ID NO: 25 - DNA, 1566 bp, Streptococcus agalactiae
atgaaaatatcacaatacaataaatggtcaattcgccgattgaaagttggagctgcatctgtaatgattgctagtggaagcattgttgctttagggcaatctcatattgtttcagcagatgagatgtcccaacctaaaacaaccattacagctccaacagctaacacttctacaaatgtagaaagtagtactgataaggcattatcaaaagttactacgatggagacaagttcagaaatgcctaaaatgcaaaatatggcaaaagttgaaaaaacgagtgacaaacctatgatggtggctacctctgttagaaaaatgatggcaacgccgacacctgtagcgatgaccaaaacgactagtgtagatgaggtaaagaaatcaactgatactgcttttaaacagacagtagacgttccggctcattatgttaatgcagcaaaagggaatggcccatttctagcaggtgtaaatcaaacgattccatatgaagcgtttggtggagatggcatgttaacgcgtttaatccttaaatcttctgaaggagcaaaatggtcagataatggtgttgataaaaatagtccattattaccattgaaaggcttaactaaaggtaaatatttctatcaagtttctttaaatggtaatacgacaggtaaagagggacaagctctcttagatcaaattaaagctaatgataaacatagctaccaagccacaattagagtttatggtgctaaagatggtaaagttgatttaaaaaacatgattagccaaaaaatggtaaccattaacattcctcacattacaactgatatggaagtaaaaaattctctaaagatggcctttaaagaaaaagtagacgtcccagcaaaatatgttagtgctgcaaaagctaaaggtccatttttagcaggtgttaacgaaacgattccatatgaagcgtttggtggggatggcatgttaacgcgtttaatccttaaagcttcagagggagcaaaatggtcagacaatggtgttgataaaaatagtccattattaccgttaaaagatttaactaagggtaaatacttctaccaagtctctcttaatggcaatacagccggtaaaaaaggccaagctctcttagatcaaattaaggcaaatggaagccatacttatcaagcaactatcactatttatggtacgaaagatggcaaagttgatatgaatactattttaggacaaaagacagtgatgattcatattaatgtcgctaaaaaagatatgaatagcacatcaatgatgatgaaaaaagataagatgacaatgcctatgaagaaagaaatgacttcatctaaaataaataccggtatgatgatgtctaacaacaagatgtcagctaatatgcaaatgtcatcacaagccaaatcaaatgataaagctggtaaaaaaatgtctatgatgtctaaaaatttacctaatacaggtgaaacaaagcaacaaaatgtaggtgtgctaggtatgcttagtctagcctttgcgacaggtctaactgcgctaggccttaaaaaatctaaacaaagatag

SEQ ID NO: 26 - DNA, 1350 bp, Streptococcus agalactiae
atgacacatattacatttgactattcaaaagtcttgggtcaatttgtaggcgaacacgagttagactacctacaaccacaagtaagtgcagcagatgctttccttcgtcaagggactggtcctggctcagattttctcggatggatggacctcccagaaaactatgacaaagaagaattttctcgcattcaaaaagccgctgaaaagattaaatcagatagcgaagtactcgtggttattggtattggtggttcgtaccttggcgcaaaagcagcaattgactttttgaataatcattttgctaatttgcaaaccgcagaagaacgtaaagcgcctcagattctttatgctggaaattctatttcatctacttaccttgccgatttagttgaatacgtccaagataaagaattctcagtaaatgtcatttcaaaatcaggtacaacaactgaaccagcgattgctttccgtgtatttaaagaacttctagttaaaaagtacggtcaagaagaagctaataaacgtatctacgctacaactgataaagttaaaggtgccgtaaaagttgaagcagatgctaacaattgggaaacatttgtagttcctgataatgttggtggtcgtttctcagtactgacagccgtaggtcttcttccaattgctgcttcaggagcagatattactgctcttatggaaggcgcaaatgctgctcgtaaagatttatcttcagataaaatctctgaaaacattgcttatcagtacgctgcagttcgtaatgttctttatcgcaaaggttatatcacagagattttagctaactacgaaccatcattacaatactttggtgaatggtggaaacaattagcaggtgaatcagaaggtaaagatcaaaaaggtatctatcctacatcagcaaacttctcaactgatcttcactcacttggtcaatttattcaagaaggttaccgtaacctctttgagacagttgttcgcgttgagaaacctcgtaaaaatgtgactattcctgaattaaccgaagatttagatggtcttggttatcttcaaggaaaagatgtagattttgttaataaaaaagcaacagatggtgtactccttgctcatacagatggtggggttccaaatatgtttgtaacgcttcctacacaagacgcttacacccttggttacactatttacttctttgagttagcaattggcctttcaggttatcttaactcagtaaatccatttgatcaaccaggggtagaagcatataaacgtaatatgtttgctcttctaggtaaacctggattcgaagagcttagcgctgaattgaatgcacgtctttaa

SEQ ID NO: 27 - DNA, 318 bp, Streptococcus agalactiae
atgaaagaaaaacaaacagccggacgtcgtcaattagaagaatttgcacctgaatttgccagatataatgatgatattttatttggtgaggtttgggcaaaagaggatcatttaacagataaaacacgttctattattactatatctgccttaattagcggaggaaatcttgaacagttagagcatcatcttcaatttgccaaacaaaacggagttactaaagaagaaattgctgacattatcactcaccttgctttttatgttggatggccaaaagcttggtcagcctttaataaagctaaggaaatttggatataa

SEQ ID NO: 28 - DNA, 471 bp, Streptococcus agalactiae
gcttggagagctttagaggatgctcaaaaatctggtaaggtaaaatccatcggtgtctcaaactttttagaaaaagacttagaaaatatcttaaaaaatggtcatgttaaacctgctgtcaatcaaatcttagctcacatcggaaatacacctttcgacttgattgattactgtcaaagtaaaggtattcaagttgaagcttattcaccaattgcacatggacaagcattgaaatctgatggtattcaaaaaatggctgaaaaatatggggttagtgttgctcaattatgtattcaatatttactacaattaaacctgatcgttttaccaaaggcttctagtaaagaacatttacagtctaatctagactttgactttgtaattagtgacgaagatatgtcgatattaaaatcacttatgtttgacgattatggggaattttctaacttccctgtttttagtgaaaaatga

SEQ ID NO: 29 - DNA, 3381 bp, Streptococcus agalactiae
atgtttagaaggtctaaaaataacagttatgatacttcacagacgaaacaacggttttcaattaagaagttcaagtttggtgcagcttctgtactaattggtcttagttttttgggtggggttacacaaggtaatcttaatatttttgaagagtcaatagttgctgcatctacaattccagggagtgcagcgaccttaaatacaagcatcactaaaaatatacaaaacggaaacgcttacatagatttatatgatgtaaagaatggattgattgatcctcaaaacctcattgtattaaatccatcaagctattcagcaaattattatatcaaacaaggtgctaaatattatagtaatccgagtgaaattacaacaactggttcagcaactattacttttaatatacttgatgaaactggaaatccacataaaaaagctgatggacaaattgatatagttagtgtgaatttaactatatatgattctacagctttaagaaataggatagatgaagtaataaataatgcaaatgatcctaagtggagtgatgggagtcgtgatgaagtcttaactggattagaaaaaataaaaaaagatattgataataatccaaaaacacaaatagatattgataataaaattaatgaagtcaatgaaatagagaaattgttagttgtatcgctaccagataaaattaagtattcaccagaggctaagcataggactgttgaacaacacgcggaattagatgcaaaagatagcattgcaaatacagatgaattgccatcaaattcaacgtataactggaaaaatggtcataaaccagacacctcaacatcaggtgaaaaagacggaattgttgaagttcactatccagatggtactgttgatgatgtgaatgttaaagtaaccgttacatcgaaaaaaactgataatacagctccaacattaaccgtcactccagagcaacagactgttaaagtggatgaagatattacctttacggttacagctgaagacgaaaatgaagttgaactaggtttagatgatcttaaagctaagtatgaaaatgatatcattggagctcgtgttaaaattaagtatcttactaaagaacctaataagaaagtcatggaagtgacaattatgaaagctactttagcagataagggcgcaattacctttactgcaaaagataaagcaggtaatcaagcagaacctaagacagttaccatcaatgttcttccgccagataaaattaagtattcaccagaggctaagcataggactgttgaacaacacgcggaattagatgcaaaagatagcattgcaaatacagatgaattgccatcaaattcaacgtataactggaaaaatggtcataaaccagacacctcaacatcaggtgaaaaagacggaattgttgaagttcactatccagatggtactgttgatgatgtgaatgttaaagtaaccgttacatcgaaaaaaactgataatacagctccaacattaaccgtcactccagagcaacagactgttaaagtggatgaagatattacctttacggttacagctgaagacgaaaatgaagttgaactaggtttagatgatcttaaagctaagtatgaaaatgatatcattggagctcgtgttaaaattaagtatcttactaaagaacctaataagaaagtcatggaagtgacaattatgaaagctactttagcagataagggcgcaattacctttactgcaaaagataaagcaggtaatcaagcagaacctaagacagttaccatcaatgttcttccgccagataaaattaagtattcaccagaggctaagcataggactgttgaacaacacgcggaattagatgcaaaagatagcattgcaaatacagatgaattgccatcaaattcaacgtataactggaaaaatggtcataaaccagatacctcaacaccaggagagaaaaacgctgttgttgttgtgacctatccagataagtcaacagatgaagttcctgtaaaagttacagtggttgacccacgtacagacgcagagaaaaatgatccagcaggtaaagatcaaactgtcaaagtgggtgaacaaccagatccgacaaaatctcttgaagcagtaccagctggaagtacagtagcgtacaaagaaccagttgatactaagacaccaggagagaaaaacgctattgttgttgtgacctatccagataagtcaacagatgaagttcctgtaaaagttacagtggttgacccacgtacagacgcagagaaaaatgatccagcaggtaaagatcaaactgtcaaagtgggtgaacaaccagatccgacaaaatctcttgaagcagtaccagctggaagtacagtagcgtacaaagaaccagttgatactaagacaccaggagagaaaaacgctattgttgttgtgacctatccagataagtcaacagatgaagttcctgtaaaagttacagtggttgacccacgtacagacgcagagaaaaatgatccagcaggtaaagatcaaactgtcaaagtgggtgaacaaccagatccgacaaaatctcttgaagcagtaccagctggaagtacagtagcgtacaaagaaccagttgatactaagacaccaggagagaaaaacgctgttgttgttgtgacctatccagataagtcaacagatgaagttcctgtaaaagttacagtggttgacccacgtacagacgcagagaaaaatgatccagcaggtaaagatcaaactgtcaaagtgggtgaacaaccagatccgacaaaatctcttgaagcagtaccagctggaagtacagtagcgtacaaagaaccagttgatactaagacaccaggagagaaaaacgctgttgttgttgtgacctatccagataagtcaacagatgaagttcctgtaaaagttacagtggttgacccacgtacagacgcagagaaaaatgatccagcaggtggggaaacaacagtaccacaaggcacaccgatcagtgatgaagaaattacaggattagtgaagattccagaaggatcaaacggcgtaccgaaagtagtaggagaccgtccgaatacagacgtaccaggagattataaagtaacggtagaagtaacgtatccagatggaacaaaggatacagtagcagtaacggttcatgtgacaccaaaaccagtaccggataaagataaatatgatccaacaggtaaatctcagcaagtcaacggtaaaggaaataaactaccagcaacaggtgagagtgcaactccattctttaatgttgcagctttgacaattatatcatcagttggtttattatctgtttctaagaaaaaagaggattaa

SEQ ID NO: 30 - DNA, 570 bp, Streptococcus agalactiae
atgcagattctcgaagactatgatggtagagcattacccaagctagaaacggatcgacttatcttgcgtcagcgaacggtgggggatgtcccagccatgtttgattacgtttgcttggaagaggttgcctatccagcagggctcagcccaatagcatctttagaagatgagtatgattattttgaaaatcgctactatcaaaatctggaaaaggcaaaattaccatctggttatggtattacggttaaaggaagtgaccggattatcggatcctgcgcctttaaccatcgccgtgaagacgatgttttcgagattggctatctgcttcatcctgactactggggtcatggctatatgacagaagctgtcgccgctttgattgaagtcggttttacccttctcaatctccacaaaatcgaaatccgctgctatgactacaataagcaaagccagcgcgtggcagaaaaactaggattcacccttgaagcaaccatccgtgatcgtaaggataatcaaggcaatcgctgtgtcaatttgatatatggtttgctgaggagtgagtgggagtaa

SEQ ID NO: 31 - DNA, 2655 bp, Streptococcus agalactiae
atgtcaaaagaactatcaccaaaatacaatcctgccgaggttgaggaaggccgttatcaaacttggcttgaccaagatgttttcaagccatcaggggatactgaggctaagccctattctatcgtgattccaccaccaaacgttacgggtaaattacacttgggtcacgcttgggatacaactctacaagatatcattattcgtcaaaagcgtatgcagggctttgatacactctggcttccaggtatggaccacgctggtatagccactcaagctaaggttgaggagcgccttcgtgagcaaggtatttcacgttatgatcttggtcgtgaaaaattcctagataaagtttgggaatggaaagacgagtatgcagcaactattaaatctcagtgggggaaaatgggtctttcggttgattatagccgtgagcgttttacccttgatgagggactttcaaaagcggtaagaaaagtctttgttgatttgtacaataaaggttggatctatcgtggggaattcatcattaactgggatccagcagctcgtacagccctttcagatattgaagttattcacaaggatgttgagggtgctttctatcatatgaattatatgctggaagatggctcacgcgccctagaagtagcaacaactcgtcctgagactatgtttggagatgtggctgtagcggtaaatccagaagatccacgttacaaagatttgattggtcaaaatgttatccttcctatcatcaataaacctattccaatcatcgctgatgaacacgctgatccagaatttggaacaggtgtggttaagattacgccggctcacgaccctaatgacttcgctgtaggtcaacgccacaacttaccacaagttaacgttatgaacgatgatggtactatgaatgaacttgcggatgaatttaatggtatggatcgtttcgaagctcgtaaggcagtagtcgctaaattagaatcgttaggaaacttagtaaaaattgaaaaaatgactcattctgttggtcattcagaacgaacaggcgttgtggttgaaccacgtttatctactcaatggttcgtcaagatggatcaattggctaagaatgccattgccaaccaagatacagaagacaaggtagagttttatccaccacgatttaacgatacttttatgagctggatggaaaatgtccatgactgggttatctctcgtcaattatggtggggacaccaaattcctgcatggtacaacgtcaatggtgagatgtatgttggagaagatgccccagagggtgacggatggacacaggatgaagacgttctagacacatggtttagttctgctttatggccgttttcaacaatgggatggccagacaccgaagcagctgacttcaaacgctacttcccaacatcaaccttggtaactggatacgatatcatcttcttctgggtatcgcgcatgattttccaatctcttgaatttacaggacgccaaccattctcaaatgttcttattcatggactcatccgtgatgaagaaggacgtaaaatgtctaaatcacttggcaacgggattgatccgatggatgtcattgagaaatatggtgcggatgcccttcgttggttcctctcaaatggttcagcccctggtcaagatgtgcgtttttcatacgaaaaaatggatgcttcgtggaatttcattaataagatttggaacatttcacgctatatccttatgaataacgaaggtttaacgttggatcaagccagagaaaatgtggaaaaagttgttaatagtcaagttggaaatgtaacagaccgttggattctccacaatttaaatgagactgtgggtaaagttactgaaagctttgacaagtttgaatttggtgttgctggtcacatcctttacaactttatctgggaagaatttgctaattggtacgttgagttaacaaaagaggttctttatagtgacaatgaagatgagaaagttgttacacgttctgttcttctttataccttagatcaaatcttgcgtcttcttcatccaatcatgccatttgtgacagaagaaatttttggacaatacgcagaaggatcaattgtccttgcaagttatccacaagttaacgcgacatttgaaaatcagacagctcacaaaggcgttgaaagcttgaaagatttgattcgttcagtgcgaaatagcagagcagaggtcaatgttgctccatctaaaccaatcactatcttggttaagacaagtgacagcgaactcgaaagcttcttcaaagacaatagtaactacatcaaacgcttcacaaacccagagacgcttgaaatcagctcagcgattactgccccagaacttgccatgactagcattatcacaggtgcagaaattttcctcccacttgctgacctccttaacgttgaagaagagttggcacgacttgaaaaagaacttgctaaatggcaaaaagaactaaatatggtcggcaaaaaactcagcaacgagcgctttgtagctaacgctaaaccagaagtcgtccaaaaagaaaaagacaaacagaccgactaccaaactaaatacgacgcaactatagcacgtattgaagagatgaaaaaattaaataatgattga

SEQ ID NO: 32 - DNA, 735 bp, Streptococcus agalactiae
atggttgagccaattatttcaatacaaggacttcataaaagttttgggaaaaatgaggttttaaaaggcattgacttggatattcatcaaggagaagtggtggttattattggcccttctggctctggtaagtcaacatttttaagaacaatgaatctcttggaagtaccaacaaagggaacagtgacttttgaagggattgatataacagacaaaaagaatgatatttttaaaatgcgcgaaaaaatgggcatggtttttcaacagttcaatctatttcccaatatgactgtactagaaaatattactttatcacctattaagacaaagggactttctaagcttgatgctcagacaaaagcatacgagctacttgaaaaagttggactcaaagagaaggctaatgcttatccagctagcttatctggagggcaacaacaacgaattgctattgcaagaggtcttgcaatgaatcctgatgtccttctttttgatgaacctacttcagctcttgatcctgaaatggtaggtgaagtcttgactgttatgcaagatttagctaaatctggtatgacgatggttattgtcactcatgaaatgggttttgcacgtgaagtagcggatcgtgtcatttttatggatgcaggcattattgttgagcaagggacccctaaggaagtatttgagcagacaaaagaaatccgcacaagagatttcttaagtaaagtattataa

SEQ ID NO: 33 - DNA, 1695 bp, Streptococcus agalactiae
atgaattataaagagatttatcaagagtggttagaaaacgactcactcggtaaagatattaagtcagatttagaagctattaaaggcgatgaatctgaaattcaggatcgtttttacaaaacattagaatttggaacggcgggattgagaggtaaacttggagcaggaaccaatcgtatgaatacttatatggtggggaaagcagcacaagcattagctaatacgattattgatcatggccctgaagctattgcacgtggaattgcagttagttatgatgtccgttatcaatctaaggaatttgcagaattaacttgttccattatggcagcaaatggtattaagtcttatatttataaagggattcgcccaacaccaatgtgctcatatgctattcgtgctctaggatgtgtttcgggtgtgatggttactgctagtcataatcctcaagcttataatggttataaggcatattggaaagaaggatctcagattttagatgatattgctgatcaaattgccaatcatatggatgctataaccgattatcagcaaattaggcaaataccctttgaagaggctctggcaagtggtttggcaagttatattgatgagagtattgaagaagcatataaaaaagaagtgcttggtttaaccattaatgatactaacattgataagtcagtccgagtagtttatactcctttaaatggcgtaggaaatttacctgtgcgcgaagttttaagacgccgtggttttgaaaatgtttatgtggtacctgagcaggaaatgcccgatcctgattttacaacggttggctatccaaaccctgaagttcctaaagcatttgcctattcagaatctctaggaaagtcagttgatgcagatatcttacttgccacagatccagattgtgaccgagtagcattggaagtcaaagatagtaagggagaatatattttcttaaatggtaataagataggggcacttctttcctattatattttttcacaacgatgtgccttagggaatttgccacatcatcctgtattggtaaaatccattgtaactggtgatctatcaaaagttattgcagataaatataatattgaaactgttgaaactttaaccggatttaaaaatatttgtggaaaagctaatgaatatgatatctcaaaggataaaacttatctctttggctatgaagaaagtattggtttttgctatggcacttttgtacgtgataaagatgctgtgagtgcttcaatgatggtagtagaaatgactgcctattataaagaacgagggcaaacacttttagacgttttgcaaaccatttacgatgaatttggctattacaacgagcgccaattttctcttgagttagagggtgctgaggggcaagaacgtattagtcgtattatggaggattttagacaggacccaatattacaagtaggtgagatgagattggagaattctattgatttcaaggatggttataaggattttccaaagcaaaattgtttaaaatattattttaatgagggttcatggtatgctttaaggccgtcagggacggaacctaagataaaatgttacctttatacgattggttgtacagaagcagatagtttatcgaaacttaatgcaattgagtcggcttgtcgtgctaaaatgaatagtactaaataa

SEQ ID NO: 34 - DNA, 1212 bp, Streptococcus agalactiae
atgtatagagaaattaccgctgtcgaacacgatcgctttgtgagcgaatccaaccaaacaaacctacttcaatcttctaattggcccaaagtaaaagacaactggggtagtcaattacttggcttttttgacggtgaaacccaaattgccagcgctagtattctcatcaaatcacttcctcttggcttctccatgctatatattccgcgtggaccaatcatggattactccaatctagatattgtaactaaggtccttaaggaccttaaagcttttggcaaaaaacaaagagctctctttatcaagtgtgatcctctcatctatttaaaaatggtcaatgccaaagattttgaaaattcgcccgatgaaaaagaagggttaatcgccattgatcatttacagcgtgcaggtgctgattggactggtcggacaacagatttagctcatactatccaaccacgttttcaggcaaacctatatgctaatcaatttggacttgataaaatgtctaaaaaaactcgtcaagctattcgaacttccaaaaataagggagtagatatacaatttggtagccatgaactacttgaagattttgcagagttgatgaaaaaaacggaagaccgtaaagggataaatcttagaggaattgactactaccaaaaactccttgatacgtatcctaataactcatacatcacaatggcttcgctagatgttgcaaaacgattagaaaaaatagaaaaagaatgtcagatagcccaatctgaaagaataaaatcacttgaacttaatcgtgagaaaaaagttaaacaacaccaaggtacgattgatcgattaaataaagaaattgattttctcaaagaagctcaaaaagcctatgaccgagacattattccattggctgcaaccctcactctagaatttggtaatacatcagaaaatatttatgctggtatggacgattactttaaatcttattctgctcctatttacacttggtttgaaacagctcaaagggcttttgaacgtggaaatatttggcaaaatatgggggggattgagaatgacttatctggtggtttatatcattttaagtctaagttcgaaccaatcattgaggaatttattggagaatttaacattccagtgaacagattgctttataaagcctctaattatgtctatgccttacgcaaaaaacgtaatagctag

SEQ ID NO: 35 - DNA, 1398 bp, Streptococcus agalactiae
atggcttgtacaacaatattggttggtaaaaaggcttcttatgatggttcgactatgatcgctagaacggaagactctgttaatggcgatttcacacccaaaaaattaaaggtaatgacatctaaagatcaaccgcgtcattacaaatcagttttatcaaattttgaagtagatttaccagataacccacttccttatacttcagtaccggacgcattgggaaaagatggtatatggggtgaagccggtattaacagtaaaaatgtagcgatgagtgctacagaaactattacaacgaattcccgcgttttgggtgcagatcctttggtttcagatggtataggggaagaggatatactcactttagtgcttccctatattcagtcagcgcgagaaggtgtggagcgtttaggtgctattttggaaaaatatggaacctatgaatcaaatggtattgctttttcagataccgaagaaatatggtggttagaaacaattggtgggcatcattggattgctcgtcgcgtacctgatgatgtttatgttactaatcctaaccaactaggaattgatcattttgaatttaataactgtgatgactacatgtgctctagtgatttgaaagagtttatcgaacaataccatttagatttgacctattctaatgagcatttcaatcctcgatatgcttttggtagccaacgtgataaagatcgtcattacaacacaccaagaagttgggcaatgcagcgttttttaaatcctgaaattgaacaggatccacgtagcttgtttattccctggtgtcaaaagccttaccgaaaaattactgttgaggatattaaatatgtgttgagtgatcattatcaagacagtgtgtatgacccatatggaccagaaggggatgcggtaagtaggagagcttttcgttcagttggtatcaaccgaactagtcaaacgtctattctacaattacgaccaaataaatcacttgaaacgacaggtgttcaatggttatcttatggctctatgccatttgcaaccatggtgccgttgtttacacaagttgagactgtaccaaactatttttcgaatacaaccaaggatgcttcaacagataatttttattggaccaatcgtttaattgcagctctagcagatccacacttttatcaacatgaagctgatattgaaagctatatcgagagaacgatggctcaaggacatgcacatattaacggtgttgatagagaagttgctgagaataaagagattgattttcaacagaaaaatcaagaaatgagtgactatatccaaaaagaaagccaagaattgttaaatcgtattctatttgatgcaagtaatttaatgacaaatcgcttttcaatgggagattaa

SEQ ID NO: 36 - DNA, 1521 bp, Streptococcus agalactiae
atgagaaagaaatttcttttattgatgagctttgtagctatgtttgcagcttggcaacttgttcaagttaaacaagtttgggctgatagtaaacttaaagtggtaacaactttttacccagtttatgagtttacaaaaaatgtcgttggtgataaagctgatgtatctatgttaattaaagcaggtacagaaccgcatgattttgaaccatcaactaaaaacatcgctgccatccaagattcaaatgcttttgtttacatggatgataacatggaaacttgggctccaaaagtagctaagtcagttaaatccaaaaaagtaacaactattaaaggtactggcgatatgttacttactaaaggcgtcgaagaagaaggtgaagaacatgaaggacatggtcatgaagggcatcatcatgaacttgacccacacgtatggttgtctccagaacgtgcgatttctgttgtagaaaacatccgtaataaatttgtcaaagcttatccaaaagatgcagcttcatttaacaaaaatgcagatgcttacattgcaaaattaaaagagcttgacaaagaatacaaaaatggtttgtcaaatgctaaacaaaagagttttgtgactcaacacgcagcgtttggttacatggcgcttgattacggtttaaatcaagttccaattgctggtcttactccagatgcagaaccttcatcaaaacgtttaggcgaattagctaaatacatcaagaaatataacatcaactacatttattttgaagaaaatgcttcaaataaagttgctaaaactttagcagatgaagttggcgtgaaaacagctgtgcttagtccacttgaaggactttctaaaaaagaaatggcagctggcgaagattacttctcagttatgagacgtaatttgaaagttcttaaaaagacaacagatgttgcaggtaaagaagtagctcctgaagaagataaaactaaaacagttgaaacaggttactttaaaactaaagatgttaaagaccgtaaattgacagattactctggtaattggcaatcagtatatcctcttcttcaagatgggacacttgatccagtttgggattacaaagctaaatctaaaaaagatatgactgctgcagagtacaaaaaatattatacagcaggttacaagactgacgtagaatcaatcaagattgatggtaaaaaacatcaaatgacctttgtacgtaatggtaaatcacaaacatttacatacaaatatgcaggttacaaaatcttaacttataaaaaaggtaatcgtggagtacgttatctctttgaagctaaagaaaaagatgctggtcaattcaaatatatccaatttagtgaccatggtattaaaccgaataaagctgaacacttccatatcttctggggttcagaaagccaagaaaaattatttgaggaaatggaaaactggccaacatacttcccagctaaaatgtctggacgtgaagttgcccaagaccttatgtctcattaa

SEQ ID NO: 37 - DNA, 1665 bp, Streptococcus agalactiae
atgaaattatcgaagaagttattgttttcggctgctgttttaacaatggtggcggggtcaactgttgaaccagtagctcagtttgcgactggaatgagtattgtaagagctgcagaagtgtcacaagaacgcccagcgaaaacaacagtaaatatctataaattacaagctgatagttataaatcggaaattacttctaatggtggtatcgagaataaagacggcgaagtaatatctaactatgctaaacttggtgacaatgtaaaaggtttgcaaggtgtacagtttaaacgttataaagtcaagacggatatttctgttgatgaattgaaaaaattgacaacagttgaagcagcagatgcaaaagttggaacgattcttgaagaaggtgtcagtctacctcaaaaaactaatgctcaaggtttggtcgtcgatgctctggattcaaaaagtaatgtgagatacttgtatgtagaagatttaaagaattcaccttcaaacattaccaaagcttatgctgtaccgtttgtgttggaattaccagttgctaactctacaggtacaggtttcctttctgaaattaatatttaccctaaaaacgttgtaactgatgaaccaaaaacagataaagatgttaaaaaattaggtcaggacgatgcaggttatacgattggtgaagaattcaaatggttcttgaaatctacaatccctgccaatttaggtgactatgaaaaatttgaaattactgataaatttgcagatggcttgacttataaatctgttggaaaaatcaagattggttcgaaaacactgaatagagatgagcactacactattgatgaaccaacagttgataaccaaaatacattaaaaattacgtttaaaccagagaaatttaaagaaattgctgagctacttaaaggaatgacccttgttaaaaatcaagatgctcttgataaagctactgcaaatacagatgatgcggcatttttggaaattccagttgcatcaactattaatgaaaaagcagttttaggaaaagcaattgaaaatacttttgaacttcaatatgaccatactcctgataaagctgacaatccaaaaccatctaatcctccaagaaaaccagaagttcatactggtgggaaacgatttgtaaagaaagactcaacagaaacacaaacactaggtggtgctgagtttgatttgttggcttctgatgggacagcagtaaaatggacagatgctcttattaaagcgaatactaataaaaactatattgctggagaagctgttactgggcaaccaatcaaattgaaatcacatacagacggtacgtttgagattaaaggtttggcttatgcagttgatgcgaatgcagagggtacagcagtaacttacaaattaaaagaaacaaaagcaccagaaggttatgtaatccctgataaagaaatcgagtttacagtatcacaaacatcttataatacaaaaccaactgacatcacggttgatagtgctgatgcaacacctgatacaattaaaaacaacaaacgtccttcaatccctaatactggtggtattggtacggctatctttgtcgctatcggtgctgcggtgatggcttttgctgttaaggggatgaagcgtcgtacaaaagataactaa

SEQ ID NO: 38 - DNA, 2673 bp, Streptococcus agalactiae
atgaaaaagagacaaaaaatatggagagggttatcagttactttactaatcctgtcccaaattccatttggtatattggtacaaggtgaaacccaagataccaatcaagcacttggaaaagtaattgttaaaaaaacgggagacaatgctacaccattaggcaaagcgacttttgtgttaaaaaatgacaatgataagtcagaaacaagtcacgaaacggtagagggttctggagaagcaacctttgaaaacataaaacctggagactacacattaagagaagaaacagcaccaattggttataaaaaaactgataaaacctggaaagttaaagttgcagataacggagcaacaataatcgagggtatggatgcagataaagcagagaaacgaaaagaagttttgaatgcccaatatccaaaatcagctatttatgaggatacaaaagaaaattacccattagttaatgtagagggttccaaagttggtgaacaatacaaagcattgaatccaataaatggaaaagatggtcgaagagagattgctgaaggttggttatcaaaaaaaattacaggggtcaatgatctcgataagaataaatataaaattgaattaactgttgagggtaaaaccactgttgaaacgaaagaacttaatcaaccactagatgtcgttgtgctattagataattcaaatagtatgaataatgaaagagccaataattctcaaagagcattaaaagctggggaagcagttgaaaagctgattgataaaattacatcaaataaagacaatagagtagctcttgtgacatatgcctcaaccatttttgatggtactgaagcgaccgtatcaaagggagttgccgatcaaaatggtaaagcgctgaatgatagtgtatcatgggattatcataaaactacttttacagcaactacacataattacagttatttaaatttaacaaatgatgctaacgaagttaatattctaaagtcaagaattccaaaggaagcggagcatataaatggggatcgcacgctctatcaatttggtgcgacatttactcaaaaagctctaatgaaagcaaatgaaattttagagacacaaagttctaatgctagaaaaaaacttatttttcacgtaactgatggtgtccctacgatgtcttatgccataaattttaatccttatatatcaacatcttaccaaaaccagtttaattcttttttaaataaaataccagatagaagtggtattctccaagaggattttataatcaatggtgatgattatcaaatagtaaaaggagatggagagagttttaaactgttttcggatagaaaagttcctgttactggaggaacgacacaagcagcttatcgagtaccgcaaaatcaactctctgtaatgagtaatgagggatatgcaattaatagtggatatatttatctctattggagagattacaactgggtctatccatttgatcctaagacaaagaaagtttctgcaacgaaacaaatcaaaactcatggtgagccaacaacattatactttaatggaaatataagacctaaaggttatgacatttttactgttgggattggtgtaaacggagatcctggtgcaactcctcttgaagctgagaaatttatgcaatcaatatcaagtaaaacagaaaattatactaatgttgatgatacaaataaaatttatgatgagctaaataaatactttaaaacaattgttgaggaaaaacattctattgttgatggaaatgtgactgatcctatgggagagatgattgaattccaattaaaaaatggtcaaagttttacacatgatgattacgttttggttggaaatgatggcagtcaattaaaaaatggtgtggctcttggtggaccaaacagtgatgggggaattttaaaagatgttacagtgacttatgataagacatctcaaaccatcaaaatcaatcatttgaacttaggaagtggacaaaaagtagttcttacctatgatgtacgtttaaaagataactatataagtaacaaattttacaatacaaataatcgtacaacgctaagtccgaagagtgaaaaagaaccaaatactattcgtgatttcccaattcccaaaattcgtgatgttcgtgagtttccggtactaaccatcagtaatcagaagaaaatgggtgaggttgaatttattaaagttaataaagacaaacattcagaatcgcttttgggagctaagtttcaacttcagatagaaaaagatttttctgggtataagcaatttgttccagagggaagtgatgttacaacaaagaatgatggtaaaatttattttaaagcacttcaagatggtaactataaattatatgaaatttcaagtccagatggctatatagaggttaaaacgaaacctgttgtgacatttacaattcaaaatggagaagttacgaacctgaaagcagatccaaatgctaataaaaatcaaatcgggtatcttgaaggaaatggtaaacatcttattaccaacactcccaaacgcccaccaggtgtttttcctaaaacagggggaattggtacaattgtctatatattagttggttctacttttatgatacttaccatttgttctttccgtcgtaaacaattgtaa

SEQ ID NO: 39 - DNA, 606 bp, Streptococcus agalactiae
ggagcaaaaaaggcagggtggactgaatacgctaggatgttagaagtcagagagcaggttgaccatgtgatgattccaaaaatcaatcaggatttaccaatctacgctggtccagaagaggacaatctgcaacggggagttggtcatctagaagggataagtttgccgattggaggggcttctacacatgcggtcttgagcggtcaaagaggtatgccagctgctcggttgtttgcggatttggataagatgaaaaaaggtgattatttttatgttaccaatctgaaagaaaccttggcttatcaagtggatcgtatcatggtgattgaacctagccaattggatgccgtgagcattgaagaggataaagattatgttacccttctgacctgtacaccttatatgggctctttgtcaactgtaatgggtgacttatcattaacaacgagagagaatcagcttggttctctctctttttggatgttcaaagcgatgagaattttgcttttaaaatttttaaagttgcgaaagccaaaggcttgtcgcttgatgtctttgataagcttgttggtcgcttctaatttggcattggaaagggatagctga

SEQ ID NO: 40 - DNA, 1059 bp, Streptococcus agalactiae
atgtcggatgttgtcgaaaaacaaacagctaaatcgtttataatgaacgtattaaatggtttagctttagggactgttattgtcttgataccaggagcaatccttggagaattaatgaaagctttactgccaatgtggagcggatttgcaactttaatcgctgcaacagcagttgcaacaagtatgatggggcttgttattggtattatggttggtctcaattttaaatttaatcccattcaatcagcatcactaggattagcggttatgtttgcaggtggagctgcaaccttccttaaaggcgctattatgctaaaaggaacaggcgatatcattaatatgggaattactgctgccttaggtgtccttttgatccaatttttatctgacaagacgaaatcattcactttgattgtcattccaacagtaacactcttactagttggaggagtaggtcatgtgttattaccttatgtcaaaatgattaccaccatgattggacaagggattgcttcattacttggtttacaacctgttttgatgtcaattttaattgcgatgattttctgtttcttgatcgtatctccaatcacaacagttgggattgctttggcaattagtttgtccggaattggttctggtgctgctaatttaggtatctgtgctgctagttttgggctttgtatggctgggtggtcagtcaattctaaggggacagccttagcgcatgttttagggtctcctaagatttcgatggctaatgtattagcaaaaccgaagattatgctacctatgatatcttcagcagcaatactaggaattctcggagctctctttaatattcaaggaacaccagctagtgcaggttttggtatcagtggtttgattggaccgattaatgctcttaatttagcaaaaggtggatggtcagttatgaatatgttattgataattataatatttgttgctgcaccaattatattgaattttatttttaattacctctttataaaagtacttaaaattattgatccaatggactataaattagatatttaa

SEQ ID NO: 41 - DNA, 672 bp, Streptococcus agalactiae
atggctagacccttagtagaacaaacagcagatcgtctattgcatttaattttagaaagagaataccctgttggtgctaagctccccaatgaatatgaattagcggaagatctagatgttggtcgcagcacaatccgagaagcagtcagaagtttagcaacgcgtaatattttagaagtcagacagggctctggaacatatattagttctaaaaagggtgtttctgaggatccattagggttctctctaataaaggacacagataggttgacatcagatctctttgaactacgccttttattggaacctcgaatagcggagctggtagcttatagaattacagatgatcagttacaattactcgaaaagcttgttggagatattgaagatgctgttcacgcaggcgatccgaaacatttacttttagatgtggaatttcattccatgctagctaaatacagtggtaatattgcaatggatagccttttgccagtcatcaaccagtcaattcatctgataaatgcgaattatacaaatcgtcagatgaagtcggatagtttagaagcacatagagaaattatcaaagcaatccgagaaaaaaatccagtagctgcacatgatgctatgcttatgcatatcatgagtgttagacgttcagcattgaaagcttaa

SEQ ID NO: 42 - DNA, 567 bp, Streptococcus agalactiae
atgattaagaaaaataaagtttttttaggagttcttttagtccttgttgttatccttggaggtggtgtattattttaccaatcacaattccaaaagacaactaatcaagcgttagctattgcttataaagatgctaaagtggctaagaaggatgtcatacatcaaaaaattgacaaagaatttgaaaactttagagggagctacgaaattgagttcaataccaaaagcgcagaatacagctatcatgtagatgctaagactggacaaatccttgagcgggacatggataataatggcttttcaaaatcgacttctcagtcaagttcatcgtcaagtcaaaaatctcataaaataagtcaagaagaagccaaaaagattgcatttaaagatgctaatatagaggaatcagaagtcagtaatcttaagatcaaagaagaaattgaaaatggaaaatcagtttatgatattgactttgtggacctgaaaaataaaaatgaagttgattatcaaattgatgcagaaactggaaaaatcattgaacgttctagagatcatatgaatgattaa

SEQ ID NO: 43 - DNA, 2043 bp, Streptococcus agalactiae
ttgaatcgtaaaaaaaggtatcgtctcactgtaaaaaagcaaaatgctagcatacctagacgattaaatcttctattttttattattgttttattatttactgttctaattcttcgtttagagcaaatgcagattgggcaacaatcattttacatgaaaaaactgacagctcttacgagttatacagtgaaagaatcaaaagcgagaggtcagatttttgatgctaagggagtagtcttagttgaaaatgatgaacgtcctactgtggcgttttctagaggaaacaatatttcatctcagtctatcaaagagttagcgaataaattatcacattacattaccttaaccgaagttgcttcaagcgatagagcaaagagagattattatttagcagataaagccaactacaaaaaagttgttgaaagtttaccagattctaaacgttacgataaatttggtaaccatctagccgaatcaaccgtatatgcaaatgcagttgctgcagttccagtgagcgctattaactattctgaagatgagttaaaagtggttgccttatttaaccaaatgaatgcgacaccaacgtttggttcagtgaaattaagtacaggcgaattaagtgatgatcaaatcaagaaactggatgctgataagaaggaactgttaggaatttctgtaacaagtaattggcatcgtcgtaaaaaaggaacttctttatcggatatattaggtactatttctacagaaaaggcaggtttaccaagagaagaagttaaaaaatatttgaaaaaaggctattcactgaatgaccgagtgggaacttcttaccttgaaaaacaatatgaagatgacttacaaggaatcagacaaattcgcaaagtagttgttaataaaaaaggtaaagttgtttcagataatattacgcaagaaggtaagtcaggaagaaatcttaaattaacgattgatcttaattaccaaaacaaagtagaaagtatcttgaaacaatactatggcagtgaattatctagtggacgcgctagtttttccgaagggatgtatgcagttgctatagaaccttcaactggtaaagtgttagcaatggctggtctgaaaaatgatcatgggaatttagttgatgacagcctaggcactattgctaagaatttcacgccaggatctgttgtgaaaggtgcgacgctatcatcaggatgggaaaataaagttcttagaggaaatgaagtgctttatgaccaagaaattgctaatatacggtcatggtttacacgaggtttgactccaatatctgcggcacaagcgctagagtattcatctaatacttatatggttcaagtagcacttcgtttaatgggacaagactataatacaggagatgctttaactgatcgaggctatcaagaagcaatggctaaactaaggaaaacttacggcgaatatggtttaggggtttctacaggattagatttacctgaatcagaaggttatgtacctggaaaatacagcttaggaacaactctaatggaatcgttcggtcagtatgatgcctatacaccaatgcaacttggtcagtatatctcaactattgcgaataatgggaatcgtttagcacctcacgtggtttcagatatctatgaagggaatgattctaataagttcgctcaattggttcgttcaatcactcctaaaacactaaataagatagctatctcagatcaagagttagccattattcaagaaggtttttataacgttgtcaatagtggaagtggctatgcaactggtacgtcaatgagggggaatgtgacaaccattagtggtaaaactggtaccgctgaaacatttgctaaaaatgtaaatggacaaacagtttctacctacaacttaaacgctattgcctacgatactaatcgtaaaatagcagtagcggtaatgtatccgcatgttacaactgatacaacaaaatcccatcaattagttgcacgagatatgattgatcaatatatttcacagttcacaggacaataa

SEQ ID NO: 44 - DNA, 1428 bp, Streptococcus agalactiae
atgacggtttttcctaaacattttctatggggaggtgcagttgctgccaatcaggtagagggtgcatttagaacagatggcaaaggtttatctgtacaagatgtacttccaaatggtggtttaggcgatttcaccgccaaacctactccagacaatttgaagctagaagcaattgatttttatcataactataaaaatgatataaaactgtttgcagagatgggctttaaagtttttagaacctctattgcctggtctcgaatttttccaaatggtgatgatagtgctccaaacgaagctggcttacaattttatgataatttatttgatgagttgcttaaatataatatcgagcccttggttaccttatctcattatgaaacaccgcttcatcttgcaaaaacttataatggttgggctgatagacgtttgatagcattttttgagaaatttgctcaaacagtcatggagcgttataaagataaggtgaaatattggttgacttttaatgaagtgaattctattttacatatgcctttcaccagtggtgctattatgaccgacaaatcacaactaagtcctcaggagctttatcaagctattcatcatgaattagtagcatcggctagagtgacaaaattagggcgttctatcaatcctaattttaaaattggctgtatgattctggctatgccagcttatcctatgacatctgatccaagagatgtcctggctgcaagacaatttgaacaacataatctgctattttcagatatacatgtcagaggtaaatatcccacttatattcagtcctatttcaaaaataatggtattaaaattaaatttgaagaaggagatgaggaagtattggcacaaaatacagtagattttctatcgtttagttactatatgagcgtgacacaagcttatgactttgaaaattatcaaagtggtcagggaaatatccttggaggcctaactaatcctcatttaacaacttcagaatggggatggcaaatcgatcccatcgggctacgcctagtcttaaatcagtattatgaacgttatcagattccgttgtttattgtagaaaatggattgggagcaaaagatcaattgatagaaacactagacggtgattatactgtcgaagatgattatcgtattgattatatgaatcaacatttagttcaagttgctaaagctattgaagatggtgttgaaataatgggatatacatcttgggggtgtattgattgtgtatccatgtctacagctcaactaagtaaacgttatggtctaatatatgttgatcgaaatgatgatggaacagggagtctacaacgttacaagaagaagtcatttggttggtaccaaaaagtgattaagacaaatggccaatcattgtttgaacatcataacagataa

SEQ ID NO: 45 - DNA, 486 bp, Streptococcus agalactiae
atggctacttttcaaattaaagaaaaaatgttttctctaggcggtaaatttactattacagaccagactgggcttccctgttatcacgttgaaggaagtttgttccctctacctaagacttttaaagtctttgacgaagaggggcatctgattagtcagattgagaagaaggttttaagttttttaccaaagtttaatgtgacattagccaatgggaatcatttcacgattaagaaagatttctcatttttgaaacctcattacaccattgaagaccttgatatggaagttaagggaaatttttgggatatagatttccaactcttaaaagacaatcaagttatagcaaacatatctcaacagtggtttcgtatgacttcaacttatcaggtagaagtttacaatgaaacttacaacgatttgacaatttcgcttgtcatagcgatcgactatgtcaaagagttagaaaaaaatgcatcaaactaa

SEQ ID NO: 46 - DNA, 546 bp, Streptococcus agalactiae
atgaaaaaaataacaactttaatcttagctagtagcttattactagttgcaacgacatcggttaaagctgatgataactttgaaatgccaacgcgttatgttaaaatgagtgaaaaatcaaaagcattttatcaaagactacaagaaaaacaacgtaaggcacatactactgtgaagacttttaataattcagaaataaggcatcaactacctcttaaacaagaaaaggctagaaatgatatctacaatttaggcattcttatttctcaggagtctaaagggttcatccaacgtattgataatgcctattctttggaaaatgtctcagatattgttaatgaagctcaggctttgtataaacgtaactatgatttatttgaaaaaatcaaatctacacgtgataaggttcaagtcttacttgcatcgcatcaagataatacagacttaaaaaacttttatgctgagttagatgatatgtatgaacatgtttatctcaatgaaagtagagtggaggcgataaacagaaatatccaaaaatataattag

SEQ ID NO: 47 - DNA, 921 bp, Streptococcus agalactiae
atgaaattaaaaaaattctttgaggatttgctggctaaactagaatatagacccattcaagtttttatgcgtcattttcaaagtgcagagatggacttatcagccatagcagttgcttattatctattagtgacagcttttccattactagttattgctgctaatatttttccttattttcatattaatgtgtcggatttattgtcacttatgcaaaaaaatcttccgaaaaatatttatgaacctgcctcacgcttagcagtagatgctttttcgaaaccgtctaccggcattttgggattcgcttcattaacagctttttggacaatgtctaaaagtttgacctctcttcaaaaagccattaataaagcatacggtgttgaccaacacagagactttgtgattagtcgtttagtgggtgtggggactgggctgatcatcctatttttactgacttttgttttaattttttcaactttttcaaaaccagttttacagataattgtaaacatgtatgatttgggagatactctaacggcgtggcttttaaatcttgcacaaccagttacatttttgactatatttttaggtattggaattttatactttattttacctaacgcacgaattagaaaagtacgttatgtcattccagggacattattttcaacgtttgttattggtttttttagtaatttaattagccaatacgtcttaaatagggttgagaaaatggtagatattaaaacgtttggttcggtcgttatctttatcttaatgctatggtttattttcttagcccacattatgattttaggtgcaatactgaatgccagcgttcaagaaattgcgacaggaaaaattgaatcaaggcgtggagatattatgtctcttatccaaaaatccaaagaagaaaaataa

SEQ ID NO: 48 - DNA, 3234 bp, Streptococcus agalactiae
atgaaattactttatactgatattaatcatgatatgacagaaatcttagtcaatcaggccgcgcatgctgctgaagctggatggcgtattttttatattgctccaaactctttatcttttgaaaaagagcgtgcagtattagagaaccttcctcaagaagcctcttttgctattacaattactcgctttgctcaattggcacgttattttactttaaaccagcctaatcaaaaagaaagtttaaacgatattggattagcaatgatcttttatcgtgctttagcaagttttgaagatggacaattaaaagtttttggacgattgaagcaagatgcttcctttatcagtcaattggtagacctatacaaagaattgcagacagcaaatctgagtattttagatttaaaatatttacattctcctgaaaaatttgaagatttattagctatttttctagtggtttcagatcttttaagagaaggagaatacgacaatcaatctaaaattgccttttttacagaacaagtaaggtcaggccagctagatgtggatttaaagaacactatccttatagtcgatggttttacccgtttctcagctgaagaagaagctttaattaaaagtctgagttcacgttgtcaagagattatcatcggagcttatgctagccaaaaagcgtataaggctaactttactaatggaaatatttattctgcaggggttgattttttaagatatctagcaacgacatttcaaacaaaaccagaatttatcttgtctaagtgggaaagtaagtctggttttgaaatgatttcgaaaaatatcgaaggtaaacatgattttacaaatagtagtcacattttagacgacactgctaaagattgtataacaatttgggagtgcattaatcaaaaagatgaagtggaacatgtggctagagctatacgtcagaaactttatcagggatatcgctacaaagatattttagttttactaggagatgtagatagttataaactacaattaagcaagatttttgagcagtatgatattccttattatttcggtaaagctgaaacaatggctgcgcaccctttagttcattttatggattccttgtctcgaataaaacgttatcgatttagagctgaagatgttttaaatctttttaagacaggtatttatggagagattagtcaagatgatttagattattttgaggcttatatctcatatgcagacattaaaggtcctaagaagttctttacagattttgttgtgggggctaaaaaatttgatttagggcgtcttaacactattcgtcagtccctccttgctccactggaaagttttgttaaaacgaaaaaacaagacggtataaaaacactcaaccaattcatgtttttccttactcaggtaggtttgagtgacaatttatcgcgattagttggtcaaatgtctgaaaatgaacaagaaaaacatcaagaagtttggaaaacatttacagatattttagagcagtttcaaacaatatttggtcaagaaaaattaaatttagatgaatttttatcgttattaaattcaggtatgatgcaagccgagtatcgtatggtccctgctactgttgatgtggttactgttaagtcttacgacttggtagaaccacatagtaatcaatttgtctatgccctaggcatgacacaatcacattttccaaagattgctcaaaacaaatctttaatatctgatattgaacgtcagcttataaatgatgccaatgacactgatggtcattttgacattatgacgcgagaaaatttgaagaaaaaccattttgctgctctctctctttttaatgctgctaaacaagcattagtgttgactataccacaattattgaatgagtctgaagatcagatgtcaccatatcttatcgaactaagagatataggtgttccttttaatcataaaggacgccaatcgttaaaagaagaagctgataatattgggaattacaaagctttattatcgcgtgttgttgacttgtatcgctctgctattgacaaagagatgactaaagaagaacaaactttttggtcagttgctgttcgttatttgcgtcgtcaattaacttctaaagggattgagataccaataattacagatagtcttgatactgtgacagtttcatcagatgtgatgaccagacgcttcccagaagatgacccacttaaattatcctcatctgctttgacaactttttataataatcaatataagtattttttacaatatgtgttaggtttggaagaacaagactcaattcatccagatatgcggcaccatggaacgtaccttcatcgtgtttttgaaattctgatgaaaaaccaagggatagaatcttttgaagagaaactcaactctgcaattaataaaaccaatcaagaagatgttttcaaatccttgtattcagaagatgcagaaagtcgttattctttagaaattttagaagatatcgcgcgtgcaactgcaaccatattacgacaagatagtcagatgactgttgaaagtgaagaagaacgatttgaactaatgattgataatactataaaaattaacggtattattgaccgtatcgatcgtttatctgatggttctttgggtgtcgtggactataaatcaagcgctcaaaaattcgatatccaaaaattttataacggtctaagtccacaattagttacctacattgatgctatcagtcgtgacaaggaggttgaacaaaaaccaccgatttttggagctatgtatttacatatgcaagaacctaaacaagacttgtctaaaattaaaaatttagatgatttagtaacaaaaaatcatcaagctttaacttataaaggattattttcagaagctgaaaaagaatttttagcaaatgggaaataccatctcaaagattccctttattcagaggctgaaattgctattttacaagcacataaccaattgctttacaaaaaagcatctgagactattaagtcaggtaagtttttgatcaatccatatacagaagatgctaaaacagttgacggtgatcagtttaagagtattacggggttcgaggcggataggcatatggcgcgtgccagagcgctttataaattacctgctaaggaaaaacgtcaaggtttcttaacattaatgcagcaagaggaggaaaatgatgacctttaa

SEQ ID NO: 49 - DNA, 999 bp, Streptococcus agalactiae
atgagcgaaactaaagttatggctttgcgcgaagcgattaatgtcgctatgagcgaagaaatgcgcaaagatgaaaaagtatttttaatgggtgaagatgtaggtgtatatggaggagacttcggtacatcagttggtatgttagaagagtttggtgctaagcgcgttcgcgacacaccaatctcagaggctgcgattgcaggttcagctatcggtgctgcacaaacaggtttgcgtcctatcgttgatttgacattcatggatttcgtaacaatcgcaatggatgctatcgttaaccaaggtgctaaaacgaattatatgtttggtggaggtctatcaactccagttactttccgtgtggcatcagggtcaggtattggttcggctgcacaacactcacaatcattagaagcttggttaacacacattccaggtctaaaagttgttgcacctggtactgttaatgagtcaaaagcacttttgaaatcttctattcttgacaataacccagttatcttcttagagccaaaagctctctatggtaagaaagaagaagttaacatggatcctgatttctatattccacttggtaaaggggatattaagcgtgagggtactgacttaacaattgtttcttatggccgtatgcttgagcgtgttatgcaagctgctgaagaagttgctgaggaaggtattaacgttgaggttgttgatccacgtacacttattccgcttgataaagaattaattatcgattctgttaagaaaactggtaaattgattttggttaacgatgcttataaaactggtggtttcactggtgaaattgcaactatggttgctgaaagtgaagcatttgattaccttgatcatcctatcgtgcgtcttgcaagtgaagatgttccagtaccgtattcacgtgtacttgaacaaggaatcttacctgatgtagcaaaaattaaagatgctatctacaaagtagttaacaaaggtaaataa

SEQ ID NO: 50 - DNA, 1758 bp, Streptococcus agalactiae
atggcttttgatgtaattatgccaaaacttggggttgacatgcaagaaggcgaaatccttgagtggaaaaaaaatgaaggtgacaccgttaatgaaggtgatgtccttcttgaaatcatgtctgataaaaccaatatggaaattgaagcagaagacactggtgtacttttaaaaattgtacatcaggcaggagatgttgttcccgtcactgaagtgattgcctatatcggagaagaaggtgaagaagtaggtacgtcatcaccttcagctgatgcaactatcacagctgaagatggtcaatcagtttctggacctgctgctccttcacaagagacagttgcagcagcaactcctaaagaagaacttgcagctgatgagtacgatatcgtagtcgtaggtggtggacctgcaggttattacgcagcaatccgcggtgctcaacttggaggaaaaattgccattgttgagaaaactgaatttggtggtacgtgtttgaatgttggttgtatccctacaaaaacatatcttaaaaatgctgaaatcctagatggtttgaaagtagcagctggacgtggtatcaaccttgcttcaactaactatgcaattgatatggataagactgttgcctttaaaaattctgtagttaagacactgactggcggtgtacgtggtctcttgaaagcgaacaaagttgaaattttcaatggacttggacaagtaaaccctgataagtctgttgttattggcgataaagttatcaaaggtcgtaacgtcgttcttgcgactggttctaaggtatctcgtattaatattccaggtattgaatcaccattagtattaacatcagatgatattcttgatttacgtgaaattcctaagtcacttgctgttatgggtggtggtgtcgtaggtattgagcttggtcttgtatgggcttcatatggtgttgacgtaactgttattgaaatggctgatcgcatcattccagcaatggataaagaagtatcgctagaacttcaaaaaatccttgctaagaagggaatgaagattaaaacatcagttggtgtttctgaaattgttgaagccaataatcaattaacgcttaaattaaacaacggcgaagaagttgttgctgataaagctcttctttcaattggacgtgttccacaaatgaatggtcttgaaaatcttgagcctgaacttgagatggaacgtggacgtattaaagttaatgcttatcaagaaacttcaattccaggtatctatgcaccaggtgatgttaatggaactcgtatgttagctcatgctgcataccgtatgggtgaagtagctgctgaaaacgcactcggcggtaataagcgtaaagcacatctagatttcactccagcagctgtttatactcatcctgaagtagcaatggtggggatgacagaagagcaagcacgtgaacaatatggtgacatattagttggtaaaaatagctttacaggcaatggtcgtgctatcgcttcaaacgaagcacatggttttgtaaaagtaattgctgaacctaagtataaagagattcttggtgttcacattattggtccagctgcagcggaattgattaatgaagcttctacgattatggaaaatgagttgactgtctatgatgtagcacaatctatccatggtcacccaacattctctgaagttatgtacgaagctttcttagatgttctcggtgaagctattcacaaccctccaaaacgcaaataa

SEQ ID NO: 51 - DNA, 1353 bp, Streptococcus agalactiae
atgggaaaatattttggtacagatggtgttcgcggtgaagctaatgttgaactgacgccagaattggcttttaaattaggacgttttggaggatatgttctaagtcaacacgaaactgatcgtccgagagtttttgtagctcgtgatactcgtatttctggtgaaatgctggaatctgctttgattgctggtctactttcagtaggtattgaggtttataaacttggtgttttagccactcctggagtgtcttaccttgtccgtacagaaaaagctagtgcaggggttatgatttcagcaagccacaatccagcacttgataatggtattaagttctttggtagtgatggttttaaacttgatgatgatcgtgaattagaaattgaagctttacttgatgcgaaggaagacactttaccacgtccatcagcacaaggtttaggtactttagtagattatcctgaaggacttcggaaatatgagaagtttatggaatcaactggtattgatttagaaggtatgaaggttgcgttggatacagcaaatggagcagcaacagcctcagctcggaatatctttttagacttgaatgctgatataagtgttattggtgatcaaccagatggtttgaatatcaatgatggtgttggttcgacacatcctgagcaattacaaagtttagttagagaaaatggttccgatatcggtctagcttttgatggtgatagtgatcgtttgatcgctgttgatgaaaatggagagattgtagatggtgataaaattatgtttatcattgggaaatatctttctgataaagggcagcttgctcagaatacaatcgtaacaacggttatgtcaaatctcggctttcataaagcgctcgaccgtgaaggtattcataaagcgattaccgctgtaggagaccgctacgtggttgaagaaatgcgtaaatcaggatataatcttggcggggagcaatcaggccacgttattatcatggattacaatactacaggggatggacaattaacagccatccaattgactaaggtcatgaaagaaactggtaagaaattatcagagttagctagtgaagtgacgatttatcctcaaaaattagtaaatattcgtgttgaaaataacatgaaagataaagcgatggaagttcctgcaattgcggaaattattgctaaaatggaagaagagatggatggcaatggtcgtattctagtacgtcctagtggtactgagcctcttcttagagttatggcagaagcgccaacaaatgaagcagttgattattatgttgatactatcgcagatgtcgttcgtacagaaattggtttagattaa

SEQ ID NO: 52 - DNA, 2634 bp, Streptococcus agalactiae
atgaaaggtcaaaaaattattgctctagctggtcttgtcctgtcatgccattttgctcttacggcatgtcatactcaagaacacaaaaattctcatcatattaaaacaaagcaggttgctaagaaaaaagctaataaaaagaaagtctctgttaaggaaagtcataaaaaacgcaagggtgttgcaggggttgactttccaactgatgatggctttttactgactaaagattcgaagattttatctcatcccgattctggaatcgttgtagcacatggaaatcattctcattttattttttactctgatttaaaaggttcaaaatttagctatttaattcctaatgcaaatgcaaaaactaataaaaagcaagcggtaagaaactttaaagcaggggcggtagctgttaatacattaaatgatggctatgtttttaatcccgcagatattgtttcagaagatgctaatggctacgtggtcagacatggtgatcatttccactatattccaaaagcaagtttatctcagcaaaagcaagtacaagcaagtagagctgtttcacgtttaggaaatcaaaataatagccattacagagttaatagttctaaaattgcagggcttcaccacccaacaagtgatggtttcttattcaatggacaaggaataaaaggcactaccccaacaggtattttagtagaacatcataatcatctgcattttattagttttgctgatttaagaaaagggggatggggatcaattgctgaccgttaccaaccacaaaagaaagttgattctaaaaaacagtcaccatcaagtaaaaagccaagaactgaaaatactttacctaaggacatcaaagataagctagcttaccttgctcgtgaattacatttagatatttcacgtatcagagtccttaaaacactaaatggtgaaattggatttgaatacccacatgatgatcatacacatgttattatggccaaagatattgatctaagtaagccaattccaaatccacatcatgatgacgaagatcatcacaaaggtcatcaccatgatgagtccgaccataagcatgaagaacacgagcacactaagtcaaataaattatctgatgaagatcaaaagaaattaatttatttagcagagaagcttggtttaaatcctaatcaaattgaagtattaacgtcagaggatgggagtatcatctttaaatatccacatgatgaccactcacacactatagcaagtaaggatattgaaattgggaagcctatcccagatggacaccacgatcactctcatgcaaaagataaagttggtatggcaactctaaaacaaattggttttgatgatgagattattcaggatattctgcatgcagatgctccaacaccattcccatccaatgaaactaatcctgaaaaaatgcgtcagtggcttgcaactgttactaagattaacattggacaaagaaccaatccattccagcgttttggtctatcattgatgcctaatattgaagttctaggaattgggtttactccgattaatgatatgacgccagttttgcaattcaaaaaacttaaacagctttggatgacaaatactggtattacagattattctttccttgataagatgccactattagaaggattggatatttcacaaaacggtattaaggatttatctttccttacaaaatataaacaattaagtcttattgctgcagctaataatggcattacttcgctaaaaccattggctgaattaccaaaccttcaattcttagttttgagtcataacaatatctctgacttgacaccgttatcaaacttgacaaaactccaagaattgcaccttgatcataataatgtgaagaatttaagtgcactttctggtaaaaaagatttgaaagttctagatttatcaaacaataaatccgcagacttatcgactctaaaaacaactagtcttgagacgcttcttttaaatgagacgaatacaagcaatctaagtttcttaaagcaaaatcctaaggtatctaatttaacaattaataatgcgaaattagcatcattagatggtattgaagagagcgatgaaattgttaaagtagaagctgaagggaaccaaattaagtcactagtattgaaaaataaacaaggttcgttaaaattcttgaatgtgactaataatcagttaacatcacttgaaggtgttaataattatacttcacttgagaccttaagtgtttctaaaaataaacttgaatctttagatattaaaacacctaacaaaacagttacaaatcttgattttagccataacaatgttccaacatcacaattgaaattgaatgaaaaaaatattcctgaagcagtagctaagaattttccagcagttgtagaaggttcaatggttggaaatggtagtcttgctgaaaaagcagctatggcttctaaagaggacaaacaagtttcagataatactaatcaccaaaaaaacactgaaaaatctgctcaagcgaatgctgatagtaaaaaagaaaaccctaaaacacatgatgaacatcatgaccatgaagaaacagatcatgcacatgtaggtcatcatcaccattaa

SEQ ID NO: 53 - DNA, 1503 bp, Streptococcus agalactiae
atgaataaacgcgtaaaaatcgttgcaacacttggtcctgcggtagaattccgtggtggtaagaagtttggtgagtctggatactggggtgaaagccttgacgtagaagcttcagcagaaaaaattgctcaattgattaaagaaggtgctaacgttttccgtttcaacttctcacatggagatcatgctgagcaaggagctcgtatggctactgttcgtaaagcagaagagattgcaggacaaaaagttggcttcctccttgatactaaaggacctgaaattcgtacagaactttttgaagatggttcagatttccattcatatacaacaggtacaaaattacgtgttgctactaagcaaggtatcaaatcaactccagaagtgattgcattgaatgttgctggtggacttgacatctttgatgacgttgaagttggtaagcaaatccttgttgatgatggtaaactaggtcttactgtgtttgcaaaagataaagacactcgtgaatttgaagtagttgttgagaatgatggccttattggtaaacaaaaaggtgtaaacatcccttatactaaaattcctttcccagcacttgcagaacgcgataatgctgatatccgttttggacttgagcaaggacttaactttattgctatctcatttgtacgtactgctaaagatgttaatgaagttcgtgctatttgtgaagaaactggcaatggacatgttaagttgtttgctaaaattgaaaatcaacaaggtatcgataatattgatgagattatcgaagcagcagatggtattatgattgctcgtggtgatatgggtatcgaagttccatttgaaatggttccagtttaccaaaaaatgatcattactaaagttaatgcagctggtaaagcagttattacagcaacaaatatgcttgaaacaatgactgataaaccacgtgcgactcgttcagaagtatctgatgtcttcaatgctgttattgatggtactgatgctacaatgctttcaggtgagtcagctaatggtaaatacccagttgagtcagttcgtacaatggctactattgataaaaatgctcaaacattactcaatgagtatggtcgcttagactcatctgcattcccacgtaataacaaaactgatgttattgcatctgcggttaaagatgcaacacactcaatggatatcaaacttgttgtgacaattactgaaacaggtaatacagctcgtgccatttctaaattccgtccagatgcagacattttggctgttacatttgatgaaaaagtacaacgttcattgatgattaactggggtgttatccctgtccttgcagacaaaccagcatctacagatgatatgtttgaggttgcagaacgtgtagcacttgaagcaggacttgttgaatcaggcgataatatcgttatcgttgcaggtgttcctgtaggtacaggtggaactaacacaatgcgtgttcgtactgttaaataa

SEQ ID NO: 54 - DNA, 990 bp, Streptococcus agalactiae
atgactgcaactaaacaacataaaaaagttatcctcgttggtgatggtgccgtaggttcttcttacgcttttgcacttgttaaccaaggtattgcgcaagagttaggtatcattgaaatcccagctttatttgataaagctgttggtgatgctgaagatctttcacatgcccttgcatttacatcacctaaaaaaatctacgcagctacttatgcagactgcgcagatgctgaccttgttgtcattactgctggcgcacctcaaaaaccaggtgaaactcgacttgaccttgttggtaaaaacttagcaattaacaaatcaatcgtaactcaagttgttgaatcaggtttcaacggtatcttcttagtagcggctaaccctgtagatgtacttacatattcaacttggaaattctcaggtttccctaaggaacgcgttattggttcaggtacttcacttgactctgcacgtttccgtcaagctttagcagataaaattggtgttgatgctcgttcagttcacgcatacatcatgggtgaacacggtgactcagaatttgccgtttggtcacatgctaacgttgctggtgtccaacttgaacaatggttacaagaaaatcgcgatattgatgaacaaggacttgttgatttgtttatttcagttcgtgacgctgcatactcaatcatcaacaaaaaaggtgctacatattacggtattgctgtcgcacttgctcgtattactaaagctatccttgatgatgaaaatgcagttcttccattatctgtatatcaagaaggccaatacggtgatgttaaagatgtctttatcggtcagcctgcaatcgtaggtgcacatggtatcgttcgtccagttaatatcccattaaatgatgctgaacttcaaaaaatgcaagcctcagctgaacaattaaaagatattattgacgaagcttggaaaaacccagaattccaagaagcatcaaaaaactaa

SEQ ID NO: 55 - DNA, 2460 bp, Streptococcus agalactiae
atgcaagataaaaatttagtagatgttaatctaactagtgaaatgaaaacgagttttatcgattacgccatgagtgtcattgttgctcgtgcacttccagatgttagagatggtttaaaacctgttcatcgtcgtattttatatggtatgaatgaactaggtgtgacacctgataaacctcataagaaatcagcacgtattactggtgatgttatgggtaaataccatccacatggtgattcatctatttacgaagcaatggtgcgtatggcacaatggtggtcatatcgtcatatgctcgttgatggtcatggaaactttggttcaatggatggggatggtgctgccgcacagcgttatacagaagcacgtatgagtaaaattgctcttgagatgcttcgtgatatcaataaaaatacagttgattttcaagataactatgatggcagtgaacgtgaacctcttgttttaccagcgcgtttccctaatttattagtcaatggtgcaactggtattgctgtaggtatggcaacaaatattccaccacataatctaggtgagtctatagatgctgtcaagttggttatggataaccctgatgttactacacgggagttaatggaagttattcctggtccagattttcctactggtgccttggtgatgggacgttcaggtattcaccgtgcctatgaaactggaaagggatcaattgtcttacgttcacggactgaaattgaaacaacttcaaatgggaaagagcgtattgttgtcacagagtttccatacggtgttaataaaacaaaagtacacgagcatattgtacgtttagcacaagaaaagcgtattgaaggtattactgctgttcgtgatgaatcaagtcgtgaaggcgttcgttttgttattgaagttcgtcgtgatgcttcagcaaatgtgattttaaataatcttttcaaattaactagcttgcagacaaattttagcttcaatatgcttgctattgaaaaaggtgttccgaaaattttgtcattacgacaaatcattgataactatattgaacaccaaaaggaagttattgtccgtcgtactcagtttgacaaagctaaagcagaagctcgtgctcatatcttagaaggtttacttgtggcgcttgatcacttggatgaagttatcacgattattcgtaatagtgagacagacaccattgctcaagcagagttgatgtcacgttttgaattatcggagcgtcagagtcaagcaattttagatatgcgtcttcgtcgtttaactggattagaacgcgataaaatccaatcagaatacaatgacttgctagctttaattgctgatttagcagatatcttagctaagcctgaacgtgttgttaccattataaaagaagagatggatgaggttaagcgtaagtatgctgatgcccgtcgtacagaattaatgattggtgaagttttatcacttgaagatgaagaccttattgaggaagaagatgttcttattactctctcaaacaagggatatatcaagcgtctcgctcaagatgagtttagagcacaaaaacgtggaggacgcggtattcaagggactggagttaataacgatgattttgttcgtgaattggtttcaacaagtactcacgatactgtgcttttctttacaaatttagggcgtgtgtatcgtttgaaagcatatgaaattccagaatatggacgtacagctaaaggcctccctatcgttaaccttttaaaacttgacgaaggtgaaacaattcaaacaattattaatgctagaaaagaagatgtcgctaataaatatttctttttcacaactcagcaaggtatagtgaaacgtacaagtgtttctgaatttagtaacattcgtcaaaatggacttcgtgctattaatttgaaagagaatgacgagttgattaacgtcctcttgattgacgaaaatgaagatgttattatcgggacacgtacaggctactctgttcgcttcaaagtgaacgctgtacgtaatatgggacgcacagcgactggggtacgaggcgttaatcttcgtgaaggtgataaagttgtgggagcttctcgtatcgttaatggacaagaagtactgatcatcactgaaaaaggttatggcaagagaacagaagcttcggaatatcctacaaagggtcgtggtggtaaaggaataaaaaccgctaatattactgctaaaaatgggccattagcacgcttagtgacgattaatggaaatgaggacatcatggtcattacagatacaggcgttattattcgaaccaatgttgctaatatttctcaaactggtcgttctactatgggtgttaaagtgatgagacttgatcaagaagctaaaatcgttactgttgcgctagtggaacaagaaattgaagataagtctaatatagaggatacaaaagaatag

SEQ ID NO: 56 - DNA, 1329 bp, Streptococcus agalactiae
atgacaatctttgatgaaagagagttaaaagaacgatttactcatgaaaatagggttagtttttatgagtttgtggctaaatatgatgctcaaatggttcctgtgatgaaagcaaagggctatcgatgtattcattcaatggagcgtacagtggtttttacttttggggaattcacgattaggcgacgtcggtggcaaaaaggagaacattgggtggtgccagttgatgaaaagctaggactgaaaaagaatgttcgctactctttagaattcatgtatcaaattgctagtttagcaaccatgatgccttatgaaaaagtgattaaggttgttcagatgatgtattgtattgtgattaccaaacctactgttgtgaaggccgttaagattagtcgtgaattgcttaaagaaaaggaagcgtatcgtttttttgatgaagatataccagtagataaagaaccagttgatatgatttatcttgaaggagatggagtcatggtcaaagctcgagaagaaggattagataatcgcaatgttgatttgtctcatttcgtggttcatacgggtagtcagaaagtaggaagcaatcgctttgtcttacaaaataaaaaagagtttgtgtcccttgataatcgtcaaacgcgtcaaaagattttggactacctttacaatcatttttacattgccccaaacaccttgcttattaccaattcagatggtggccatggctataccccatatgtttttaaagagattgcgaaagcactcaaagtgaagcaacacgaacacttttgggataggtatcatgtcaatgaaaagatcaaaagtttttttaaactctatccagtggaactgatgactggcgcttttcagagcattaaacagcatgataaagaaaagcttagaactgttttggatacgacagaagcattgatactgatggaagaagaaatggaagggtttaaccagttcaaacgaaagttgttaaacaattttcaatatactaaatcagctgaattgagaggtttcagtcgtgcaggaataggtgttatggagtcacaacatcgaaaaattacctatcggatgaaaaagcgcgggatgtattggacaattcagggagctgagacgatgagtcaattaattgtcctatcgtatgaaggacagctaagagatctcttctttggttcttggcgtgaagactatcagaaatatcaagagctagaaaaccttagtgcgggaaaaatcaaacatgaacagaataaaatcaataagagatatgatctccagacacttggtcggcttaggtacggtaggcatcgtaatttatag

SEQ ID NO: 57 - DNA, 384 bp, Streptococcus agalactiae
atggcatatttatcaaaattatccgatttggatccatcgttgatggatgcggattctgaacaaatttatattcctaaagtcttgtttgagcataatgactttaaaggcttgacctacaaagagattttattatattcttttttgttaaatcgtttaagagagccattagattttattcaaaaaggctatgatgataatgaagatacctatgttcactttaaggtcgaagatttatgtgaactactcaaccagagtaagacaaccgttatttccttgaagaaaaggttagctcaatatggtttgatagaagaagtgaaagcaggtagtcaccagccgaatcgtatttatttaacagataaattagttccatatattaaggggtaa

SEQ ID NO: 58 - DNA, 279 bp, Streptococcus agalactiae
atgacagataatcgctttgcccaattaaaagaaaactttgaaaagggatctcctaaaaggcgagttccaacgtctcgcccaatcgcagctcaaaaagcgcctgagagctataacaaaaagggacggtatccattttcgctccaccaagatgtgcgttatgataaattagaagcattagtagcttatcatggagctaagtctgcatcagattatctggagaggttgattgttcaggaatgggaaaagatgcagcggaagcttaagaacaaagaaaaataa

SEQ ID NO: 59 - DNA, 3150 bp, Streptococcus agalactiae
atgtttagttggttggaagctctttattacactctgatacaactggcaaaagtgaaccggttgaatgctcttttcttagttagcgttgtgggttatctttgttaccagggaataaaactcgtcagaaaaaccataagaaacttttttcagctgatgaagggtttcataggtgatagagagaacatcaagaaatgcatcaaaaacaagaaagaggcactagtccattcttggaaacatcgtcaagatattgattggaaatcaactggaaaagataagagtaaacagttatggaatcttatgaagcgacttgcgacagttgctccttcatttttgttcttattattgggaaatgttctctttcgtctcatttatcaactgccttttgtaaagcaagacagaaagcgatttgacaaggaaatgaagcccttgctctacttcaagaactatcgtagttttgtgttcatgggaataggtttcagtttcatagcgtttattctcacaaactattttgtgacggttttaagggctgctattcgttttctatatttctcaatcatgacgttaagagataatagccaagtcgttagctttaacgttgatagtttgctcatccagaatttattcaatgctagggtatttgtgatagctcccattctagcagtgccaatctttctcattggtttagtcgtagcttggcggtctgcttgggttaactttgaacagtaccgtgattataatcataatgaagaaggggatgatcgctttgcgactgtcaaagaaatccaccagcaatataagaaagttcctaataaaacggaaacttatccaggtgaaggaggtgtgcccgttcttcatgaaacaagaaagaatttgacaggcttaacgcttaaatctcaaatgctttggcaaaaccgtacctttagtcgctatttaacgaatgcggaaaggattttagggctcttatcgacgccttcaggagattattacatcgatgatagcaccacaaacttgatcaccatggggattactcggtcaggtaagggagaagctcatattgcccctattattgatattaatagccgtgcggaaattcaaccgtcactgattattgcagaccctaaaggggaacattaccagtcctcttataaaaccatgcgtcggcgtggctatgatgttaatgtcctttctttccaaaacatggattggtccatgtcctataaccctttagctcttgcgattgcagcagctaagaagggttactatgaaatgacacagacaagggttaatgcggttgcagaagccatttatcgtaaaacgaaacctggtagcggtaatggcaatgcaaaatactgggaagatacctccatttccctctttaatgccattgctatggccttaatggaccgtgctaatgaaaccgtcaggaatggtgaaaccgatgcttgggataccgttacagttcgtaacattgccaagtttttgactgacttgggttctgaagaagtctttgtcaatgattttggagagattgttgagaatcctgataagaaccaacaagtgaagaagaaatctaaaatcacggtttactttgataacttgcgtaaaatcaatcaagaacaattttccaaatttagagatatggctgatttaaactttaggtcttctgacttcgcttcagaagaaactaagggaaatgtcttctctagcatgatgtcaggtattaacttattcttgcaagataatattgctaaactaacctctaaaaactctattgacctagaatcggttggtttcccacgtcgcttgtctatcaagtttcgttctagttccaatgtcgctatgcgtaacgaatacactcataagacggctaaggttaccattactagtcaagctgtttggggtaaaaccactaaacaagttatccacgtagatgctgcaacagctctgattgatggtgaaggctatctaacctatgtgattgaaccccagcttcctgatcaattcttggtaacaattgactttaatcacgaaaacaatggtggttcagctattcgtcacaaaactttccaattctcagctgagaaagtctataagaaacgtggtaacgttattacgttggatgactacacgaaaaaaccagttttggatcatatcaaagttactgttctcaacaagcaagatgataaccttctccagaaagaagatattgacctgatttattcagataatcctaaagtgatttacttggtaacacctccaaataggactgaatataatagtattgtatctctgtttttggatcaattgtttaatgccaattatgagttagctctgtcaaatggtcgcaagtgtgtcaatcgaattcttcatatcctcgatgaattcacaaacattccagctattcctcacatggataccaagatttccattggtcttggtcaaaatattctctactatctctggattcagaacttgaaacagttagtcagtgaatatggcgagaatacagcggaaaccattcgggagaactgttctttgaaagtttatatcaaatctactgccccagcgaccaacgagtacttcagtaaagagttggggactcggaccattacacgtcgcagaaggtcaagtaatattctagatgaagctaatccaaatgtttccattgaaaatcctagacaggaactcttaacaccgacacagctctcgaaactccaagaaggggaagcggttattttgcgtggtgttaaaggtcgagacaatgcaggtcggaaaatcacaacggatccgattttcttgcatgagaaaacgagccttccttatcgctacatgttcttacaagaagaatttgaccagtcgatggctttggcagatattccagtggaaagtgggcatagggaccttgacctgcaagatatagcagtaggggcacaaagcacttttaataagattattgattggcggatggctctaactgaccgtatgagaacaaatgggaagatacctcaattagcatcaagaaaacaaacgattaaagctctaagtcaatctcaatttacttctccagcagacctaacacaagctgtgattgcagaggtatttgatgaggaagatgatgacgatcttttctttgtggatgatgtcatgtaa

SEQ ID NO: 60 - DNA, 2802 bp, Streptococcus agalactiae
atgaattctaacacaaaaggtcacggatttttccgcaagtcaaaagcatacggcttagtatgtgctattgcattagcaggtgcatttacattagctactagtcaagtgtctgctgatcaagttacaactcaagcaacaactcaaacagtaacgcaaaatcaagcagaaacagtaacatcaactcaacttgataaagcagtagctacagctaaaaaagcagctgtagctgttacaaccacacctgcagttaatcatgcgacaactactgatgcacaagctgatttagctaatcaaacacaagctgttaaagatgttactgcaaaagcacaagctaatacacaagctattaaagatgctactgctgaaaatgcaaaaattgatgctgaaaacaaagcagaggcagagcgtgttgcaaaagaaaacaaggaaggtcaagcagccgtagatgcacgtaacaaagcaggtcaagcagccgtagatgcacgtaataaagcgaaacagcaagcgcaagacgatcaaaaagcaaaaattgatgctgaaaacaaagcagagtctcaacgtgtaagtcagttaaatgcacaaaataaagcaaaaattgacgcagaaaataaagatgcgcaagctaaagcaaatgcgactaatgcacaattacaaaaagattatcaagctaaattagcggaaatcaaatcagttgaagcttataatgcaggtgtacgtcaacgtaataaagatgcacaagctaaagcagatgcgactaacgcacagttacaaaaagactatcaagctaaattagcactttataatcaagctctaaaagctaaagcagaagcagataaacagtctattaataatgttgcttttgatatcaaagctcaagctaaaggtgttgataacgctgaatatggaaactcaatcatgactgcaaaaactaaacctgacggaagtttcgagtttaaccatgatatgatcgatggtgtgaagacaatcggctatgggaaattgacaggtaaagttaatcatcattatgttgctaacaaggatggctctgtgacagcatttgttgattctgtcactctttacaagtacgagtatcgtaatgttgctcaaaatgctgctgttaaccaaaatattgtatttagagttttaacaaaagatggtcgtcctatttttgaaaaagctcataatggtaacaaaacttttgcagaaactttaaacaaaactttacaactcaatcttaaatatgagcttaaaccacatgcttccagcggtaacgtcgaagtctttaagattcatgatgactgggtacatgacacacatgggtctgctttagtgtcttatgttaataataatgatgctgttcctaatgtggtcatcccagaacggccaactccaccaaagccagtgaaagttacacctgaagcagaaaaaccagtacctgaaaagccagttgagcctaaattggtaacgcctacattaaaaacttatactccagtcaaatttattccgcgagaatacaaaccagaaccaatcacccctgagacgtttacccctgagaaatttactccagctcaaccaaaagtgaaaccacatgtgtctattcctgaaaagattaactactcagttagtgttcatcctgttttagttccagctgctaatccttcaaaagctgtcattgatgaagcaggtcaatctgttaatggtaaaaccgtattaccaaatgcaacattagactatgttgctaaacaaaactttagtcaatacaaaggtattaaagcttctgcagaagcgatcgcaaaaggttttgcatttgtagatcaaccaaatgaagcgttagctgaattgactgttaagtctatcaaagcatctaatggtgatgatgtatcaagcttgttagaaatgcgtcatgttttatcaaaagatactttagaccaaaaacttcaatctcttattaaagaggcaggaattagtccagttggtgagttttacatgtggactgcaaaagatccacaagctttttataaagcttatgttcaaaaaggactagatatcacttataatctatcctttaaaatcaaagctaactttactaaaggtcaaatcaaaaatggtgttgcacagattgattttgggaatggatatacaggtaatattgtagtcaatgatgttactgttccagaagtacataaggatatacttgataaagaggatggtaaatcaattaataatagtacggttaagttaggtgatgaagtgacctacaaacttgaaggatgggttgtaccagcaaaccgtggttacgatctttttgaatacaaatttgtggatcaattacaacacacacatgatctttacttacgtgataaagtggtcgctaaagttgatgtgacattaaaagatggtacagtcattaaaaaagggactaatttaggagagtacacagaaacagtttacaacaaaacgacaggtcattatgagcttgcctttaaaaaagagtttttagctaaggtttctcgtgaatcagaatttggtgcagatgattttattgtagttaaacgtattaaggcaggtgatgtttacaatactgctgatttatatgttaatggatataaagttaagtcagaagcagttgtgactcatactactgagaaatcaaaaccagttgaaccacaaaaagcaactccaaaagctccagctaaaggactgccatcaactggtgaagctagtatgacgccacttactgcaattggagcaattatcttatcagctctaggcctcgcaggctttaaaaagcgtcaaaaataa

SEQ ID NO: 61 - DNA, 2262 bp, Streptococcus agalactiae
atgaaacaaataaaaattatcacaggacttacagtcgcaacactatccgcagtggtagggaatgtatacgcagaagatatcacaccgacagcaccagttaatgagccacaagtttcaagcgaaaccgcaaaaacgcctcaagttacagaaagtcaagttaatagcgcaaaagttactgccgatcaagcaataagtgatgttaataaccaacaaattgtagttgatgaggctcaaaagcagaaagatcaatcacaacaaaatcttgtaaaagccacatcaacagtaactgaagctgaaaaagtcgctgctgaggcaacacctgaagttgttaaagaagctattaaagctgtcactgaagcaaaggaagctgttacggatgctgaagctaatgtagtcgatgcacaaaagacggaacaaaaagctaatcaagaagtacaatcgcaagctaagactgttgatgaaaatgttaaagttgttgctgataaagaatccgaagtgaaacaagcagagggtgttgtaactacagctcaagaagctattgatagcaaaaccgctaacactaatgcatcagaagcagaaaaagcagtgactgagaagcaaacaaagcttgaaactgctgaaacaaatcttacagaggcacaaaaacaagatgccaaaatcgctgaagaaaaacgacttgcagaacaagaagttgttaataaacaattagctgtgacagatacacaaactcttttgaagaagcttgttactgagattaataacgagaaagtaagcactagtttagaaaaccaagcctattttaaccaacgtgacggttcatgggcgggctattatggcaattatacttttgccgctactggctgtgtaccaagtagtttagcaatggtatttacggagttagctagacgccaaattactccaactgaaatcgccaattatctttggaacaattcaaatgagtttaataaaaactatggtggaacaagtggcaaagggttagtacaagctactaaacatttcggttttgtaccaactcatttagcatctcaatctgctattgtggaagccttacaggcaggacaccatgtcctagcagctgtccaacaagataaattttctccttggggtatcaattacagccatgagattgtcttacgtggttactcaaatggcaatacttatgtttacgatccttataatcgagctaacattgggtggtaccctgttgctaatttatggaatgaacaaagtagagacgcaattgacacatctagtgtaggcgtaccatttttcaaaattacaacacaaaaaatggcccaattagaagctcagaaagcacaagttcaatcttctctaaatacagctaaaaatcagttagctaaaacacaagacgtattaagaacactagaagcaacacctcttaaaacaccagaagcacaagctaagcttaatcaagccaaagaagctctagctcttgcacaagcagactatactaaagcgcaagaagctgttaagttagctagtcaagacttagctgttaaagaagaaacacttaaaaatgctcaggctgatttattaacgaaacaaacagccttgaaagatgctcaaactgttctcgtggctagtcaagttaaattagctgatcttaaagcaactttagctactgttgaaaataacgttaagaaagctcaagctactttaacagatgccaaagcaattgttggtcaaaaacaagcaaaattacttgctttacaaaatgcccctaaaattctagcagatgctcaagctaaacttgtaactgctaaaaatgatttagctaataaaatggctattttagatgaagcagtcgcaaaactaaaatccttacaagccgttcaagccgaagcccaaaaacaataccatgttgtttttgaagcctataaagcagtacgagatgccaaagaacaagctaaacttgcagaaagctataaccatattatcgcacgaggcggtgaggctatcccagttgttgacgaaacagataaaataactggatatgtagatggtagccagaaagcagttgctaatgaagtgactcttgccttaactagtaacggtgcaccccttgaaagtccagttaataaagaaaaccaaaacgtaacaaaatcatctcaagctttaccacatactggtgaagctggattatccattttatcagtattaggtgtaggtcttatctcaactttagggcttactagtttgaaaaaacgtcgcccacattaa

SEQ ID NO: 62 - DNA, 1920 bp, Streptococcus agalactiae
gtgagattaacccacgtgagtttgtggatgccatcaaagagaagttggccgctcaaattgcagttgttaaggaaaggagtgattgagttggaagatgaactgaagaccccttatcttgatcaatacacagacaatttaacggctaaagtcactaaaaaatcggatgactaccaagtttatggacgaaacaaggaggttcaatccgtcatcatctctcttctcagacgaaccaaaaataaccctattttagtaggagaagcaggggttggtaaatcagccattgtggaaggtataacgcttgctatcttacgtggccaagttcctgaacctttaaaaggtttaacggttcgttccctggagttgtctagtttgatgagtgaagatgacgaaggctttattgctaagtttaagaagattattgaagagatggttgctacacgtggtcataatcttctctttgtagatgaatttcatacgattattggtgcgggtagccagaatggtcaagcccttgatgcaggaaatgtgattaaacctgtcttagcacgtggtgatattcagctgattggagcaaccaccttagatgagttccatgagtatattgaaacagatagagccttggaacgtcggatgcagcctgttatggttgaagagccaacgatttcacaagctattaccattattgaacaagctaaagtcatttatgagaagtttcatgggattcaaatttcctcagatgctgtgcatcaagcaatccgtttatctgttcgctatttgacagatcgattcttgccggataaggcctttgatttgatcgatgaagcggcgacgattgcttcagttgaagggaaaagtaaggtgacagaaaaagatattgctcaagttttaaaagataaaacgggaattccagtcactactatcctaaagggagatcaagagcggttagagggtttcaaagaaaggctgatgaatcgagtcaaaggtcaagaagatgccattgaggccgttgtagatgcggtaacgattgctcaagctggtttacaaaatgaaaaaaggccgcttgcatcattccttttcctcggaccaactggcgttgggaaaacagaattagccaaagcaattgcagaagcactttttgatgatgaagctgccatgattcgttttgatatgtctgagtacaaacaaaaagaagatgtgactaaactcatcggcaatcgtgcgacaagaataaaaggacaattgactgaaggagtaaaacagaagccttattgtgtcctgttactagatgagattgaaaaagcacacagtgaggtaatggatcttttcttgcaagtgctagatgatggtcgtttaacagatagttcgggtcgtttgattagctttaaaaacaccattgtgattatgaccaccaatattggcgctaaaaaaatcatcaataagtgggagttgaaaggaaactttaaagatttaaccgatcgagatcggaaacaatttgaaaagtcgatggacagtgagcttcaaaatgagtttcgtccagaatttctcaataggattgaaaataagctcatcttcaaccttttagaacgtgatgtgattgaaaaaattgcagaaaaaaatctatctgagattgcggataggatgaagcgccaaaatttaacactgtcatatgagcctagtctgattcagtatctctctgatgttggtactgatgtgaaaaatggcgcacgtcccttagaacgactgatgaaacgaaaagtgctggcacccatttctgtaaaaagcttacagttagataagtcaaagcaaggctataacgttcatctctgggttgagggacgggctccagacggcaatcatcgtcaagaacaacgtcaaattcacatggagatagagggagaaagagataacttttttagctga

SEQ ID NO: 63 - DNA, 4731 bp, Streptococcus agalactiae
atggcagaagaaaatgcacaacagccatctttacgtggaaaaagccgtcgagaacgtgttgaatttgctcgttcccgtgatattttagatgtggcccatgaattgaatatggaactttttcgagatggcaaaaattatcgttggaaagagcacgattctatggtaattacacctgcaactaatcagtggtactggttttcacaacgtcaaggaggtgatgtgattgcgcttgtagagacgataaaagaaatcggcttcaatcaagcatttgaatacctgaatgaaggtacatttaaagaatttactgtggtcaatcaagtaaaagaacctttttcttattatttagaaccttacgaacagctttttgttgaagcaagacgttatttgaaagagaatcgtggcttatcagatgacactattgattttttttatgataaaggagtacttgctcaagccaatgccaaggtaggtgatatgattgagcctgttttggtgtttaaaaacttggataagaacggccaagtggttggcgctgctctacaaggcttagtagctgcccccgataaatatttcggtcggggttacctcaaacaaatcatgaaaaattcccaaccttacaacggcatgcatgttgatattggcacaccaaaccgcctagtctttgcggaaagtagtattgatcttatgagttactatgaaatccacaaagatagcttatcagatgttcgtttagtttccctagaaggcttgaaaacaggaacaataggaaggcatctcatccaattaagagctgaaatggaacgtcgtcccctctcctccagttggactgatgaaatacttgctcagggattagatgaggctgtaaagcaaggctatttcaaagatggtaagaacagtcatctccttacgctagctgtagataatgatgtaaaaggtaaacaattgattgaagagttaaaagataagagcatcccagtcattgatgccactcctcctaaagcagaaggtcaatctaaaatggattggaatgcctatttgcaggaaaccaaggctactttttctactgaaaaatatcaagaaaagattgatcacctaatatcagatgttattttaggtgatgaaacttattatctttggcatgatgatgagttggtaaatttaggagcaggagactctattatacaggcgtttcatcatcagctggaagacagacgttatgttattaatcaggcagaactttacgttgaagagtccagtaatgatggggctactggctatctatcaattgaaggacatgtattagataaggatggtattagtgactatttatctgatcaagctttaacagatgcggaaaaagtagcattcttagaaactttacagacagaactaccagatatttgggacgagatagtcaatcattatgacaaggtctttgaagaagttgtcgttaaatatggactcagagaaaaacatgcggacataattcaggaacaagagttggatttagaccctttagttgttccagaagcaaaagaaaagtcccttgaaatgaatcaagagactaacactggcggcgaactatttaatcgcaattccagttttttaggagaagattctccggggacagcaccgcagcccgttgagccaactgctcaacctgattttcctaccaatgttcgcttacattttaccactgatgatggaaatatgtcaaataaagcatttaggaaaaacatgcgaaccttgaatttatatgctaatacgatgagagattcggcacaatggtacttatcagaaatagccgatactacaatgagttatgtttataaaactcctcatgaagagggagtacaggttcttagtgtgcattttggtaaaaagaattggatgcacttaacaggagtgacaccagtatatgaaaattgggtagattcactttctgaacaatttattgatgatattgctaatagtaagggacattttaaaaatctaaagtttgcactagggactcctgataagttaaaggttcttaacttacttcctgaaattattgaatcagatacctttgtatttaatgatttatcatctgttcaaaagttaaataatcttgatttatcacaggcgcttaatcctgaagatagcgatttacttttgctatttagagatgaggggcttcatcaagtgcctgcttcgttgatgaggataaagggcgatttagaagaaagattatctcatatagatagtgggacagtgttaggagtttaccgagaaagaaatggccaacttgagcaagtttctgtcaatgaggagtatgtcaaagatagtggtcaagaaatgctatctattttacagaataagcactatgaagaggctcttgatagtggtcaagaaatggttcaaacggatggtttttcagccgaagatttcacaaaagttttggatgctgtctatcatgttggtgttccagatgatttagcacgtgttccagaaggagtcttacctgtttggcaaaaatatcttgaggtatcagaagagaatcaatgggacttagaacaaatgattgattatgcggataagaacagtcttttagtaaaagattctgccttctataaagagtggaaagaggatatgatctataaaaatgactatcatgttcgcttacaatttgctgagaattgggataatggcgttgaactgcctttccgtacagaacaattgattgattacaaaacgtttgtcacaggactttatgaagctaatcaagctcatcatcaacgcagacaagaaagtcagcttccttatacaaaaacagagtttgacatttatgctcctggcggacagctcattaaagataatgtccattatgctattggagatgaaacaagacctgtttcacaactcatggggttaggttatcgtcgcctacctggctatcaggaattagctgtgatagataacagtattctttctcagctggaaaataaggagctaaatcaagaaattgcttctgaagctaatgaacattccttaaattcacaagaaatacctaaagaagataactatccaagagaagctttcacttctcctaaacaagacatcaaaaaggggctagctcaacgagtagaagagattgtggcagaagatgctactaagattttagtatcttccattcctcaagttcaagagaatttatcagtcgaaggaaacttggtcggtactccacaagcggataatcggatgctatacactaacctagaagattttggccaagattatcaattagagcttgcagtttatagtccaaaacgggttgactttttagaagatgtgcaggctccgtggaccttggccctaattagaaaagaaaaaaagataggttatttagcgtatggtagtgattgggcaaaagaatttcagattgaagaagagctagaacatttagctgcacaaattggagacgaaaaagtaccagagggactctataaacaagctgaagtagaggcttttatagctagtcatcagggaaatgaaagccttcaggaaccaatacctactattgtagctgaaccgtttgactataccagtgcctccgcctatgagatcagcgaacacgctttccaaaagattcgtgagtacacacaatcccctgaggacttgcttgagtacatggatttcatgagtaagttcccacaactttcacctcgaaatgtcgctcttatccatgaacaatggcgtggcgcaaatgcagtcgcaacttacgaacaatggaaagccatgggagaagctctaggtattaaaccagacgatgttgtccaaacaaaagcaacttatgttaataagcggacaggagagacgaaggaagtcgttcatcaagggttatctgttaagactggcgaaaaatcgaaaattacgctctttagaccgctaatggttaaaatgatcccagttcttgatgagaatggtcaacagctgaaaaatgataaaggtaatccaaagtataagaagctatcagaagcgtcacttcaagagaaagctttagtaaaagacggtaaacttccagttcgtcaatttcaggagagagattcaaaaactggtcaaccaaggtttacgacttacaaagtttttgagttgtcacaaactactctgaagccaggaagctatcctaaggctatgccaaaccgtcatttcaactttaatgtggataaagtcaagactaaagaggtattagaagggctttgtgactatgcggaaaagattggggttagcctaatgaaagatgatgctcatgttttggataatgccaaaggagctttttattcagaagaacagctgattcttattaatcctaataatacacctggagaaaaaattgcaactaccattcatgagttagcacatgcaacccttcataatcctaagttggaaaaacagtataaagagttgccgaaaggacaaaaagaatttgaagctgagatgaccagttacttgttgtcaaaacactttggcctagatacgtctgaaaaggcaatccattatatggcaagttggacagataatctaaaagcgttagaggataaacaattggcagactctctgaaacgagttcatcaaacggtttcgaaaatgttgaagcaagttgaaaaatatacgaaccctcaccagctaggaagggggaaagaacacggtctaaattttcctaaagccccaaccaaagggtctagtcgttaa

SEQ ID NO: 64 - DNA, 2367 bp, Streptococcus agalactiae
atggatgtatcgtctagtccgaatattacatttatgctgcaatacacagaggctaatcctcaatatgtggactatactaacagagaagaggctgtcaaaattgatgaagaattgtccttagaaacgaacaggcaaatgattgaaggattaactgaagacgagttgactcgtattcaggaagctgtccctgaaacgcagttgaattttagggaatacattgattatatgaaccgctcgtatgcaactgaagaacaatctaaagaactaacagctatctttactcaagaagcagattatcttcagaaactacgattaatcgatctaaaaaataagttggaatcagcttatcaaaatggttcacttctctggcaaggagttatttcgtttgataatgcttttcttgcggaacagggattgtatgatgttgcgactggtcaagttgatcaaaaagcgattaaggcagtgatgcgtgatatgatgccaacacttatccagaaagagggcctttctgattctgctttttggtgggggaatatccatctgaatacagataatatccatatccattttgggctttctgaagttgaatctaaccgtgagaaaatattctatcagccacgtggacgtatggagtacaaaggtaacttctctcagaaaaccatcaaccggtttaaaagtggtgtgtatcatggattgctgaaagaagaaacaagatccaatcttctcagaaaagaacagattttagctaatctcaaagcggacttcataacatctatttaccagaaggacaagattacttcttcagctgaaaaaaattttttggaacaagcctacaatcatttgccgctaaataagaagtggcgctatggttctaatgccagagattttgcggttagtaagttctttcttgatcgctatttagattcctatttaaacaatgaaggtagtgctgcctatcaagaatttttgaaagagactagagattttcttcagacttatgaaggggtttattcagctgaaaaaaataaaatctatgaaaaactacgtaaagttgatgggcaaacgatcagaacgcttgcagaatcaaaaggatatgatttagaacatcatttggcacgtcgtgtaatggatttaagagagcgtttagccaataatatcttacgttcgtttagagaagctgcaccccaaattcaagacgttcagctggaaaaaaatttagagagtttttctgttttgaaccagaagaaaattttagaacaacatcctgaagcaagtgtggtaaaaagtcagaaagcttggcagaagttaggctactttgtgaaggctggagagcagccacttgaaattataaggccagtctataaatcttatgataagcatggtaaaggtataggacggccagaatttgtatcagatactgtttatgatattagtcagctaacagaaaatattcagctgaaaagtctaaccttgaaagacctctctctgttttcttctaacgagttaaaagagttagtagatgctgctaagttaaagactaatccaacagagagagaacgccgtgaattaggtacctatcgttatgcgttgaaacttagcatattagaatctagtcagaaggaattgcaggttcgtcaaaagctactagaacaggtacagccactagcgtctgatcaaccatttttagattttaagaaacagttaatagctcaggaattacaagctatagcgctacaattgactcctaattacaagctatcagaagatgataaagccttgaaaaatcgattgaagaggcagtttgaagatagtgttgcgctacctgtttcaaaagctactcctggtgccatacaacttcctattaggcaactttggactgagctaggattggttcatcacattcaagatgaaaacattctaacgcttctgaaagggacatcaacgacgaaacaagcttatatagaagaacttcagactcatatctctatttttcagttgaaatatcagattaacaatagaaacaagcagataagccagttatcggatgaagcaacaataaaggagatgaggatagctaatgctaaaggtttctctgagctaaaacgtctatatgatacattacagccatcagatgatggtcaaaatcagattagtcaagctgtttctaaacaattacaagaacgaaaagttatcaaaaaagctcaattacaacagacgcagagaagcggaaaaatcaatacagacttcatgcgacaattgacagcttctcttaatcgttcacaacaagcaagtaaaaaagcattgatggaacgtgcacgtagtgatgaacgtgaggaacaagaagaacgtaggcaagctcaacgttaa

SEQ ID NO: 65 - DNA, 801 bp, Streptococcus agalactiae
atgaagaagaataaatttctattagtcagcattgtatttatcatcatttttgtggtacagccacaaaattttcaatctttaaaaaatatatttactcaaaatgatatagctagtcaattgaatatatcaagttcacctgaagaaaaaaatgatggcttaggaacggcctatcaaacgcaaaatgaagatttgaaatctaaaagttttgatggtcaacatcaagtcatagtggttaatgaaaaagcacaatttacggcagaagagttgagcatgagaaatggttcatgggaaaaatacgataacctagattttttaaatcgtgttggggtcgcagaagctatgttaggaaaagagttaatgccaaaagaggcacgtcaggacatttcttcagtcaaaccaactggctggaaaaataaaaaaattaccttcaatggaaagcaagattatctctataatcgttctcacttaattggatttcagttaagtggtgagaatgccaatgtgaaaaatctctttacaggaacacgtgcccttaatgcaaactttaacgatgataaatcgtccatggtgtactatgaaaatgaggtcgcaaactacattaagaaaacaaatcatcatgttcgttatcgagtgaccccacttttcaaaaatgtggagttagtagctcgtggcgtacgtatagaagcacaaagtattgaagatgagaccatctcatttgatgtctatatttttaatgggcaaccaggatatgacattgattatttgacgggatcatctgaaaaaataatgattacaaaatga

SEQ ID NO: 66 - DNA, 348 bp, Streptococcus agalactiae
gtgactaaagaaattaaaattagatccattccagaaaaaacatgggcacagctacatatgatttcggaagaatatgagtatccgtcttttaatgaatttatgcttgctcaattgcaacggattgtcgaaaatggtggtcttgatttatatgataataaatttgcggaaaccttggcagttattaaagaacaacaagcacaaatattggatcagctcctaaaaaacgaaatcaagttactggcttatcatgcaaagcaagatatagtggaagagctaacaaccgactggttacgatttatggatgatgttgatgcgctggctgcggaaagaggagcaggaggacgttga

SEQ ID NO: 67 - DNA, 843 bp, Streptococcus agalactiae
ttgttatattattttatttacttgataaaagtaattggaaatggccttaaattatcactgatttgtggtttaaattggctcatcaaaatagtattcaaaggacaattttatcttttctcagctgtcttttgtggcttgttgacctactatatgccacaagatattcaattatttacagtgagagttttagagctaatcatcatgctaaaagtgataatagatgttacccatacagctctttcaagagattttaaacggatgaaaacgcctctttttttaggagtgatgtacgtcttctttctagctggtaacagttatattaaagcacatcttttgacagaagttatggttaatcatcttatttcgttttggcttatcagcctgttttttgccactcttgtaatagttattcagcccagattatttaagcattatctgttaaaaaaagtcattgataaggaatacttgggtatccgaaaattcacagactctcttcctccagaaatcaatttgtacaaggatgcggacgaagaagatgcggacaaacggatgcgactgatcaaccagaatgtcatcaaacacccctatcaagaagttgttgaactgagctttttgaatagagaagtgataacagctattggctataaagccgttccatttgaaaaagaaactgaacgtacttttatagacgatgataccatctattatcccatttttacggttcaccctttcagaaatttggaagggaaatcagatttttatcacatactaatgaaacttaaactcagtcgaaaagcggcctttacaaaaaatggtgagcgattattaattagagatttttaa

SEQ ID NO: 68 - DNA, 495 bp, Streptococcus agalactiae
atgattagaaatgaattttataatcagttaatcaatagtgagccaataggttttattgatcctttcactgacttaggagaatttgattctattcagatgaagttcaaacaacctgttagaaatctggtaaataagtactctggtaaaccttataatcttagttggcaaaataagattgaacagatgagagtgctatatattaaatatcagaaaagcttgaagctagaagatgaagaacaagaggttcataaccgagttaaaaataaaaagtctaaaaaatatgttcatgaaatcgttacaacatatttgaagttaggattcaggtttaaagaaattgaagcaagggtatccctattcaatactcgtcttcgtcggaactggaaaagaagcgactatgtgacaactgataaccctgaattctatttgaagaaggatctacagaatggttattgttctccaaattcatttcttcctcggagtatgaaaataaactaa

SEQ ID NO: 69 - DNA, 1272 bp, Streptococcus agalactiae
atgaacgaaatcaaatgccctcattgtggaacagcttttgccatcaacgagtctgaataccatcaattactagaacaaattcgtggagatgcttttgacaaagaagtaagtgaacggttggaaaaagaacgtctaatattaggggagcaagcaaaaaatcaattacaggaagttgttgtagaaaaagacaaggagatagctaaacttcagtacaaagtcaaacaatttcttatagaaaaagacaatcttctcaaagacaatgagtaccaactcgctgagcaattaaatcaaaaagacatgatgcttcgcgaccttgaaaaccaaatcgatagactacgtttagagcatgaaaatagcttgcaagaggcgctaacaaaagtcgaacgagaaagagatgcaatacaaaatcagttgcacattcaagaaaaagaaaaagatttagctttagcttcagtaaaaagtgattatgaagtacaactaaaggcagccaatgaacaagtagaattctataaaaacttcaaagctcaacagtctactaaagcagtaggagaaagtttagaacattatgctgaaacagaatttaataaagtgcgacatttggcctttcctaatgcttattttgagaaggacaatacattatcaagtcgtggctcaaagggggactttatctatcgagaaaaggatgaaaatgaccttgagtttttaagtatcatgtttgaaatgaaaaatgagtctgatgatactatcaagaagcataaaaatgaagattttttcaaagaattagataaagatcgtcgtgaaaaatcttgcgaatacgcagttttagtaactatgcttgaagcagacaatgactattataatactggaattgttgatgttagtcacaaataccctaaaatgtacgttatacgtccacaattttttatccaattaattggtattctaagaaatgcagcactcaataccttaaaatataaacaagagcttgctttgatgaaagaacaaaatattgacatcacacattttgaagaagatttagatattttcaaaaatgcatttgctaaaaattataattctgcaagcaaaaatttccagaaagcaatcgatgaaatagataaatctattaaacgtatggaagctgttaaggctgctttaacaacgtctgaaaatcaactacgtcttgcaaataataaattagacgatgtttctgtcaagaaattaacaagaaaaaatccaacaatgaaagcaaaattcgatgctctaaaagactaa

SEQ ID NO: 70 - DNA, 843 bp, Streptococcus agalactiae
atgaatcattttgaactatttaagcttaaaaaagctggactaacaaatcttaatatcaacaatattatcaactatctcaaaaagaatagtttaacttctctatctgttcgcaatatggccgtagtatcaaaatgtaaaaatcctactttctttatagaaaattataaacagctagaccttaaaaaacttcgacaagaattcaaaaaatttccagttctatcgattttggattctaactatcctttagagttaaaagaaatatataatccaccagttctacttttttatcagggtaatattgaacttctatctaaacctaaattagctgtagtgggggcaagacaggcatctcagataggttgtcagtctgttaaaaagattatcaaggagactaacaatcaatttgttatcgtaagtggtttagcgcgtggcattgatacagcagcacatgttagtgctttaaaaaatggcggcagtagtatagctgttatcgggagtggtttagatgtttattatccaacggagaataagaaacttcaagaatatatgtcatataatcatctcgtattatcagaatattttaccggagaacaacccttgaaatttcatttccccgaacgtaaccgtattattgcagggctgtgtcaaggtattgtggttgccgaagctaagatgagatctggaagtttaattacctgtgaaagagcattagaagagggacgagaagtttttgccattcccggaaatattatcgatggcaaatcagatggatgccaccatcttatccaagaaggagctaaatgcattatttcaggaaaagatatcctttctgaatatcagtag

SEQ ID NO: 71 - DNA, 357 bp, Streptococcus agalactiae
atgactgaacgaacattcgaagatattgaacttgacttaaagttattccaaataaagcttgataatgctgagaatagtaaaaggctcttacaaaaattgaaaaacgacgtcatggagttacaaatagagttactagaatcattaaaactcggtgatgcctatttaacagaatcagaagaattagaagagaataatgactttattctaacggtaaatagtgaaacactaagtttatcctatgacaataggataaacttagtttctaaagagattatggattatgaaaatgcattagataagttgtattatgaaaaacagagtttgatgcaaaaaagtaatgaaagaaaaggaggttaa

SEQ ID NO: 72 - DNA, 1233 bp, Streptococcus agalactiae
ttgttcaataaaataggttttagaacttggaaatcaggaaagctttggctttatatgggagtgctaggatcaactattattttaggatcaagtcctgtatctgctatggatagtgttggaaatcaaagtcagggcaatgttttagagcgtcgtcaacgtgatgcagaaaacagaagccaaggcaatgttctagagcgtcgtcaacgcgatgcagaaaacagaagccaaggtaatgttctagagcgtcgtcaacgtgatgcagaaaacagaagccaaggtaatgttctagagcgtcgtcaacgtgatgcagaaaacagaagccaaggtaatgttctagagcgtcgtcaacgcgatgttgagaataagagccaaggcaatgttttagagcgtcgtcaacgtgatgcggaaaacaagagccaaggcaatgttttagagcgtcgtcaacgtgatgcagaaaacagaagccaaggcaatgttttagagcgtcgtcaacgcgatgttgagaataagagccaaggcaatgttttagagcgtcgtcaacgtgatgcagaaaacagaagccaaggtaatgttctagagcgtcgtcaacgcgatgttgagaataagagccaaggtaatgttctagagcgtcgtcaacgcgatgttgagaataagagccaaggcaatgttttagagcgtcgtcaacgtgatgcagaaaacagaagccaaggtaatgttctagagcgtcgtcaacgcgatgttgagaataagagccaaggtaatgttctagagcgtcgtcaacgcgatgttgagaataagagccaaggcaatgttttagagcgtcgtcaacgtgatgcagaaaacagaagccaaggcaatgttctagagcgtcgtcaacgcgatgcagaaaacagaagccaaggtaatgttctagagcgtcgtcaacgtgatgcggaaaacaagagccaagtaggtcaacttatagggaaaaatccacttctttcaaagtcaattatatctagagaaaataatcactctagtcaaggtgactctaacaaacagtcattctctaaaaaagtatctcaggttactaatgtagctaatagaccgatgttaactaataattctagaacaatttcagtgataaataaattacctaaaacaggtgatgatcaaaatgtcatttttaaacttgtaggttttggtttaattttgttaacaagtcgctgcggtttgagacgcaatgaaaattaa

SEQ ID NO: 73 - DNA, 1722 bp, Streptococcus agalactiae
atgaaaagactaacttattattttaaggggtatatcaaagaaactatctttggaccccttttcaaattattagaagcctcttttgaacttttggtaccaatcgttattgcaaaaatgattgacgagaccattccacgaggggatagaagtagtttactgttgcaaattggattgattttctttttggctgcggtgggtgttgtagtagcgataactgctcaatattattcttcaaaagccgcagttggttatacgagacaattgacagaggatctctaccaaaaagtcatgtcactggggaaaaaagacagagatgaattgggaactgctagtttgattactcgtttaactgctgatacatttcaaatccaaactggtttaaatcaatttttacgtttatttttgagggctccgattattgtttttggtgccataattatggctttttccattagcccctcattgactatttggttcttggtaatggttgtcacgttatttatcattgtttttgtaatgtctcgactattaaatcctatttaccttaaaatcagaacttcaaccgattatttggtaaagttgactaggcaacaacttcaaggtgtacgagttatccgtgcctttaatcaagtagatagagagagtgaagcatttaatgatatcaattatcattatacgaatttacaattaaaagcaggtaggctttctagtttagtaacgcctctaacatttctagttgttaatatcactttggttgtgattatttggcgtggtaatttaaatatagctaatcatcttttatcacaaggaatgttggttgctttaattaattacttattgcaaattcttgttgaattgttaaaaatgacaatgttggtgacatcactgaaccaaagttatatcagtgctaagcgaattatagccgtttttgaaagaccgtctgaaataattgatgacaaacttgagccaaaatattcgaataaggctttagaagtacaagaaatggcattttcttatccaaattcttctgaaaaagctttatctgatattactttttctatgaatgtaggagaaactttagggataattggtggaactggctctgggaaatcaaccttggttaatttactgcttcatatttataaagtgcaagaaggggatattgatatatatcatcagggaaaaagtccagatacaatttcaaattggcgtaccctggtaagagttgttcctcaaaatgctcagttgtttaaaggaactattcgttctaacctttctttgggacttggtaaagttagtgaggaaaaactttggactgctttagaaatagcacaagctagtgattttgtaaaagaaaaagatggtcaacttgatgcccctgtagagagttttggtagaaatttctctggtggtcaaaggcaaaggttgacgattgcaagagctttagttcaagataagataccatttttgattttagacgatgcaacatctgcattggattatttaacagaagctcgtttatttaaagccataactaaacatttcaaccaaactaatcttattattgtatcacagagaattaatagtatacaaaatgcagatagaatcttactccttgataaggggaaacaagttggttttgataatcatcaatctttattagctcataacaaagtttataagtccatttaccattcacaaaattttaaggaggaggagtaa

SEQ ID NO: 74 - DNA, 1275 bp, Streptococcus agalactiae
atgaaatttaatgagcaaagtaactcgcaagcagcacttctaggcttgcaacacctgttagctatgtatgcaggatccattcttgtacctatcatgattgctagtgctcttggttataatgctgagcaactaacttatcttattgcgacagatatttttatgtgtgggattgccaccttattacaattacaattaagtaagcactttggagtgggtcttccagttgtattagggtgtgcctttcagtctgtagctcctttatcaattattggtgcacaacaaggttccggctatatgtttggagctttaattgcttcaggaatatatgtcgttttagttgctggcattttttctaaagttgcaaatttctttcctccaattgtaacaggatcagttattactacaattggtttgacattaataccagttgcgatgggaaatatgggtgataatgcaaaagaaccgagcttacaatctttaactttatcactggtaacgattggtgttgttttattaattaatattttcgcaaaaggctttttgaagtcaatttcaatccttattggactcatatcaggtacaattcttgcagcatttatgggcttagttgatgcttctgtggtagcagaagcaccacttgtacatattccgaagccattttattttggagctcctagatttgaatttacttctattttaatgatgtgtattattgcaacagtttctatggtagaatcaacaggtgtttaccttgcgctttcagatattacaaacgataaattagacagtaagagacttcgtaatggttaccgttcagaaggattggcagtattacttggcggcttatttaatacctttccatataccggtttttctcaaaatgtgggactggtacagatatctgggatacgtacgcgtaagccgatatattttacagctctcttcttagttatacttggcttgttacctaaatttggcgcaatggctcaaatgattccaagtccagttcttggtggtgctatgttagttttatttggtatggtagcacttcaagggatgaaaatgcttaatcaggttgattttgagcataatgagcataactttatcattgcagccgtatcaattgcagcaggagtaggttttaatgggacaaatctcttcattagtcttcctaatactttacaaatgtttttgacaaatggtattgttatctcaaccctgacagctgttgttttaaatatcattttgaatggattgcctaaaaaattaatatga

SEQ ID NO: 75 - DNA, 3237 bp, Streptococcus agalactiae
atggctaatacatacgatttaatttcacagcgtattgaagcacaacgacagaaactcatcgctatagatattgtggccgttgcgagctcactaggacttaacttgaaacaaggttcaggtggacatctctattgggatgaacatgatagttttcatatttacccccaaactaacacctttcgttggtggtcaagaagcatggggaccaataccattgatttagtccaagtcatccaagaagagctaacaggaaagaaacctagctttcgagaaactgtcaactttttagaaacagggcaatttgaatcggttacggtaacaccagtcgttagagaaccctttaagcactacctcgctccttatgaacatcacaattttgacttagggcgacagtatcttaaagaagaacgagggctatctgatgagaccattgattttgctttggcatcaggtagtatgagctctgcgacattgaaaaagggtgattattttgaacctgttattatctttaaaagttttgcggaagacggccgaatgatcggcggtagccttcaggggatcgttgaaaataaagtccagcatcctgaacgtggccgtctcaaacaaatcatgaagcattcagacggtctagcaggttttcatttggacgttggaacacctaaacgtctcgtgttttcggaagctcctattgaccttctctcttattatgaattacataaggagagtttacagaatgtccgcttagtcgctatggatggggtcaaaaaaggggtgattagtcgctatacggctgatttattgacagatggccagtattctcaaaccatgcccagagagtcgattagaggagcgatagatgccattaaccaaacgactagaatccttaaaaacaatcccaatatgattaccattgccgttgataatgacgaggcaggccgaaactttattaaggagttacaggaagatggcattccaattaacgtagacctcccaccacggaaagaacaccagagtaaaatggattggaataattatctgaaacaaaagaaaggattactaaaaatgccacaaacagaaggcacacaaaaagccccagaacaagttctggagcatgaaaaaatggataggagccaaattagttcgggctctttagaggacgaccctcaaggcagtgccaaacctgtatccaaaagggatacctttgagcaagctgttaccagccacccgactttctcctatcctttactacagtttagcacagaagaagcctttgtgtcaaacgttagagatggctaccacatcgcaagtgaggaggatattcggaatctcaattactatgcccctagtctccaacaaacggctaactggtatcgggataatctggcagaccgtcaagtgacttatatgttaaaaggggataaggagataaaggcgcttcaggtcagttttgccaaggataagtttgcccacttaaccggtattcgtccgattggaaaagggttgtcagctgaaaaactgttagatgattttgcgaaaggtcgaggttcctatcctaatctgaccttatcaaatggttttaatgacaagatacaagttttgccaatgattcaagaactatctcaatccaagtcttttgtctttacagatttagaggaagttcaaaaaatgagaaacttaaaggccagtcatgcgattcaatccaataatcggagtttagtcgtcgctttaaaaactattgatgatgtcacctttccttcgtccctcctaagaggaaaaaagaatctaaatgatgatctgattcaaaaggcgaaagaaaatgaagttctaggtgtactcagtgagaaagatgggaacatcacggtgctgtccgttaacgataagtacatccaagatggtgggcaagccttaaaagatatgattaaaaatggcgaacttgaaccactccaaatggagacgatacagcgacatgttcctcatgagaatgcctatcctaaggattctgacggtgatggcttaaccgatgatgaagaaatcgctctaggcaccaatccctttagttctgatagtgatggtgatgggactccagataatgtcgaaaaggcaaatggaacagaccccaccaatgcttctgataatgaggtgacaaggcaacaagaagccaataaacgtgacttcactttgtcagaaatgattaaagccaaaaataccgcagcgctgaatcaacacttacaagacggcatcaaacagtattttgatagtgatacctataagcaatacctggaagggatggcccacttcaataactactcgccacgaaatattcaattgattatgtcacaatttccagaagcatcgatggttgcgtctttccaagagtggaggaagcgaaatggttcggttaaaaaaggtgagaaggccatctatatccaagcccctgtttctgttatgaaaaaagatgagaatgggaaacctatccttaatcctgaaacgggagaaaaggagaccatcacttactttaaacctgtccctgtctttgacattaaacaggtctctccccaagaaggaaaagaactcaatctccctaaagccatgggaactattccagaacaattggataaagaatactaccaaaatgtctatcgtagcttaagagatatttctcagaataacaataaggttcccattcgatttagagaacttggacaagaagatgggttctatagtccacagacaaatgaaattgttattaagaaagggatgtcttatgaacgaaccttgtcaacgctgattcatgaaatggctcattcggaattacacaacaaacaaagtttgacggaacgctttgatggtaaactaacaagaagtaccaaagaacttcaagcggaatccattgcttatgttgtatccagtcatctaggttttgataccagtcaagagtcatttccttatttagcgtcttggtcaaaagaaaaagacgggcttgccaacttaacagcacaattggaaatcgtgcaagaagaagccaaaaacttaatggaacggattgatcaacagttaagtcaatatcaaacagtaacactgaataaagaaacccaacaattgactaaacaagaaatgaaaaagcagactcatcccttttatcaaagtttagcagccgctaaaacatcaagagcacaagtcaccactcaggagaaggaagcaagcgtaaaaaaagacaatcgacctacgatgccgtag

SEQ ID NO: 76 - DNA, 2799 bp, Streptococcus agalactiae
atgaattcacaagaaacaaaaggtcacggattttttagaaaatcaaaagcatatggtttagtatgtgggattgcactagcaggtgcatttacattagctactagtcaagtgtctgctgatcaagttacaactcaagcaacaactcaaacagtaacgcaaaatcaagcagaaacagtaacatcaactcaacttgataaagcagtagatacagctaaaaaagcagctgtagctgttacaaccacaacagcagttaatcatgcgacaactactgatgcacaagctgatttagctaatcaaacacaagctgttaaagatgttactgcaaaagcacaagctaatacacaagctattaaagatgctactgctgaaaatgcaaaaattgatgctgaaaacaaagcagaggcagagcgtgttgcaaaagctaataaagcaggtcaagcagaagtagatgctcgtaataaagcaggtcaagcagccgttgatgcacgtaataaagcaaaacagcaagcgcaagacgatcaaaaagcaaaaattgatgctgaaaacaaagcagagtctcaacgtgtaagtcagttaaatgcacaaaataaagcaaaaattgacgcagaaaataaagatgcgcaagctaaagcagatgcgactaatgcacaattacaaaaagactatcaaacaaagttagcaaacattaaatctgttgaagcttataatgcaggtgtacgtcaacgtaataaagatgcacaagctaaagcagatgcgactaacgcacagttacaaaaagactatcaagctaaattagcactttataatcaagctctaaaagctaaagcagaagcagataaacagtctattaataatgttgcttttgacattaaagcccaagctaaaggtgttgataacgctgaatatggaaactcaatcatgactgcaaaaactaaacctgacggaagtttcgagtttaaccacgatatgatcgatggtgtgaagacaatcggctatggtaagcttacaggtaaagttaatcatcattatgttgctaacaaggatggctctgtgacagcatttgttgattctgtcactctttacaagtacgagtatcgtaatgttgctcaaaatgctgctgttaaccaaaatattgtatttagagttttaacaaaagatggtcgtcctatttttgaaaaagctcataatggtaacaaaacttttgcagaaactttaaacaaaactttacaactcaatcttaaatatgagcttaaaccacatgcttccagcggtaacgtcgaagtctttaagattcatgatgactgggtacatgacacacatgggtctgctttagtgtcttatgttaataataatgatgctgttcctaatgtggtcatcccagaacagccaactccaccaaaaccagaaaaagttacacctgaagcagaaaaaccagtacctgaaaagccagttgagcctaaattggtaacgcctgttttaaaaacttatactccagtcaaatttattccgcgagaatacaaaccagtcccaagtacccctgagacgtttacccctgagaaatttactccagctcaaccaaaagtgaaacctcatgtgtctgtacctgaaaaaattaactataaagtagcggtgcatccagtacagataccaaaggccacaccaactaagaaagttctagatgaaaacgggcaatctattaacggtaaatctgtattaccaaatgcaacattagactatgttgctaaacaaaactttagtcaatacaaaggtattaaagcttctgcagaagctatcgcaaaaggttttgcatttgtagatcaaccaaatgaagcgttagctgaattgactgttaagtctatcaaagcatctaatggtgatgatgtatcaagcttgttagaaatgcgtcatgttttatcaaaagatactttagaccaaaaacttcaatctcttattaaagaggcaggaattagtccagttggtgagttttacatgtggactgcaaaagatccacaagctttttataaagcttatgttcaaaaaggtctagatattacttataacttatcatttaaagttaaaaaagagtttactaaaggtcaaatcaaaaatggtgttgcacagattgattttgggaatggatatacaggtaatattgtagtcaatgatttgacaactccagaagtccataaagacgtgttagacaaagaagacggcaagtctattaacaatggtactgtcaaactcggtgacgaagtcacttacaagcttgaaggatgggttgtaccagcgaaccgtggttacgatctttttgaatacaaatttgtagatcacttacaacacacacacgatctttacctaaaagataaagtagtcgctaaagtagcaattacacttaaagatggcactgtaattccaaaagggacaaatctagttcaatatactgagactgtctataataaggaaacaggtcgctatgagttagcctttaaggcagacttcctcgcacaagtttcacgttctagtgcctttggggcagatgactttattgtagttaaacgtatcaaagcgggtgatgtttacaataccgcagacttctttgtcaatggcaataaggtaaaaactgaaactgtggtaacacatactcctgagaaaccaaaaccagttatgccgcaaaaagtaactcctaaagcaccagctttaccatccacaggagagcaaggggtatctgtcctaacagtacttggtgccgccttactctcactcttaggccttgtagggtttaaaaagcgtcaacagtaa

SEQ ID NO: 77 - DNA, 2232 bp, Streptococcus agalactiae
atgaatcagataaaaattatcacaggacttacagtcgcaacactatccgcagtggtagggaatgtatacgcagaagatatcacaccgacagcaccagttaatgaaccacaagtatcaagcgaaaccgcaaaaacgcctcaagttacagaaagtcaagttaacagcgcaaaagttactgccgatcaagcaacaagtgatgttaatgcacaaaaaaatgtagttaataatgctcaaaatcaaaaaaatcaagcacaacaaaaacttgttaacgcaactacaacgttaaatgaaacacaaaaattagtgcaagaatctaccaatcaaaatcaagtacaacaaacagttgattccgcaaagcaaaggttgtcgcagacagaagctaatcaaaaaattactcaaactgaacaagtcaaagctcaaaatcaagttaatgcacaacaaacagttgttgttaacaatgagcatgatgttgcaactaagacagctgatgttaaacaagctcaagcatcagtcgatacagctaaagatgctttgactaatactatagttaatagtgatttaaataaagcacagtcaaacgtcacaactaagacagctgatgttaaaactgcgacagatgcacttacaaaagcacaagcgactgataaaacacttactaatcaaaaagcaaaagcacaacaaatagttgattcagcaaaacaaaacttatctgctaaagatacacagctttcacaagctaatgctgaggtcaatcatcacaagtttaaaacggctctagggcaaagtcattattacaatcaacgtgataatgcttgggctggggtatatggagggcatacatttgcttcaactggatgtgtcccatcagcattagcaatggtttactctgatttatcaaatcggacaataacgccgagagagatagctgattacttatacaacaacacagatgaattcaataaacgtttcggtggcacaagtgggaaaggtattatttctgctactaaagcgtttggttatgttgtgactcatttggctagcaaaaatgctataactgaagcattaaaagcaggtcatcatgttgttgctgctgtacaaaataataaattcagtccctgggggcctcaatacagtcacgaaattgtattgagaggtagttctaatggcaatacgtatgtttatgatccgtataaccgtgataacaatggtttttacagtgttgaccgcatttggaatgaacagtcacgagatagtattgatactgctggtgtaggtgtaccgtttttcgcaattatgactaaaaatatggctaatgctttaactaagcagtcacaagctttagcaagccaacaagttgctcaaaaacaattaaatgatgcacaagctaaagcaacaggtcttaatgcagtaactatgcagacaccgattgcacaagctaatttgattaaagcacagtcaaatttaaaagatgctcaaaagcgattagcagaagcacaagcatcagtcaaattagctaatcaagataatgttaaaaaacaagctgacttaacaaaagcagagtctaaattaaaagatgctcaaaagcaattagcagcagcacaagctaaattgacaacaagcaaaacaaaacttaatcaattaaaacaagtgttagcagaagcaagtcaacaagtagcccaagcaaatcaagattacaagcaagctaaagataatctaacacaaaaaactgcttatctaacaaatctacgcaatgcacaagctaatttgattaaagcacagtctgatgtagcacaagctaaagataacttagcaaataagattgctaagttacaaagagaagtagcttatttacaagagttaaaaactaaagcagtagatgcgcaatcacagtatcaaaaagttttatcagcttataagtcagttttatcagctaaagcaagtttaaaattagcggaagagaaagctcgacttgataaaaagggtcacgaagcagtagcagtagttgacgaaacaggtaaaattactagctatattacttctaaacacaaaatagaaatgaaatctcttgttgcaactaagacaactgatgttaaacaagtatcagttgctaaagcaagcgtgttgccaagtactggtgatgttaaacaagtatcagttgctcttctgggtatgttattaacgttctctggttttttaggtatacgtaaacaaagtaaaaaagttattaattaa

SEQ ID NO: 78 - DNA, 762 bp, Streptococcus agalactiae
atgatatcacgtaaagttgcgcttgtgacgggggcatctgctggttttggtgcagctattgttactaaattagtttcagatggttatagcgttattggttgtgctcgtcgaatggataaattaaaatgctttggagaaaagttttcagagggttacttttatccacttcaaatggatattacaagtagagaatcggttgacaaagctttagaaagtctgcctaaaaatttgcaatcaattgatttgttggttaataatgcaggtttagcacttggattggataaatcatatgaagctgattttgaagattggatgactatgattaatactaacgttgtaggattaatttacttgacacgatgcattttaccgaaaatggtagaagttaatagagggttaattatcaatttgggatcaactgcaggaacaattccttatccaggagctaatgtctatggcgcatcaaaagcttttgtaaaacaattttctctcaacttgcgtgccgatttagctggaactaaaatcagagttactaacctagaacccggtttatgtgaagggacagaattttcaactgtacgtttcaaaggagatcataaaagagttgaaaaactttatgaaggtgcgcatgcaattcaagcagaggatattgctaataccgtgtcatgggttgctagccaaccagaacacattaatattaatcgcatagaaataatgccagtcagtcaaacttatggacctcaacctgtttatcgtgattaa

SEQ ID NO: 79 - DNA, 1116 bp, Streptococcus agalactiae
atgatttatttagacaatgctgctactaccgctctaaccccatctgttattgagaaaatgaccaatgtcatgacaagtaactatggtaatccatctagtatacatacctttgggcgtcaagcaaatcaacttttacgtgaatgtcgacaaattattgctgaatatctaaatgttaattcacgtgaaattattttcacttctgggggaactgagagcaacaatacagctatcaaagggtatgctcttgcaaatcagctaaaaggtaaacatattattacctctgaaattgaacatcattcagtcctacatactatgacttacttatcagagcgatttggttttgatattacttacttaaaaccaaaccatggacaaattactgcaaaagacgttcaagaagctttacgagatgatactattatggtatctctcatgtttgctaataatgaaaccggggactttttaccaattcaagagattggtcagcttctcaggaaccaccaagctgtttttcacgttgatgccgttcaagtctttagcaaaatggaacttgatcctcattctttaggaattgactttttagctgcttctgcccataaatttcacggtccaaaaggtgttgggatactttactgtgctccccatcactttgatagtctacttcatggtggagaccaagaggaaaaaaggcgtgcttcaactgaaaatataattggtattgctggaatgtctcaagctcttactgatgctacgactaacacccttaaaaattggactcacattagtcagctgagaacgacctttttagatgctatttcagaccttgacttctatcttaataacggtcaagactgcttacctcatgtacttaatataggttttcctagacagaataatggcttgttattgacacagttagatttagctggattcgcagtttcaacaggttctgcatgtactgcaggaacagtcgaacctagtcatgtcttaacaagcttgtatggagccaactcaccacgtctaaatgaatcaatacgtattagtttttcagaactaaatacccaagaagaaattcttgaattagctaaaaccttaagaaaaattataggagattaa

SEQ ID NO: 80 - DNA, 1344 bp, Streptococcus agalactiae
atgtctaggaaaacatttaaacatatactatcgattggagtttgcacgctcgtactatcgatgagtctttattacactgaaaaagcccacgctattgctggtcctagtgaccgccaatacgtagaaaacccaaatcctcacattattgtaaatgttacaggtactgatcaaaacggaaatagcattttaccgcattacatcgaagtcaatgtaaagatgggacaaactttaagtaaagaagaaattctagattatattgctcgaaatttaaactctagtgttggaggagaaagtaaaaacgttcaatacagcaacatcgagtttaaggaaagtgcttatctgaagcgtcaattagatgatggcaagacagaagaaatagcaattgataacgacggtgttactgtacctaaagacggtccaaacaaattttggattgacgttccagtaacttgtactgttactcctatcgtaacagaaacacatgaagttcgatgggggactccagtcgctatatcacaccgtatttactttgttgaagaatcttctggaaaagttttagatgaatacacaaatctacacactgctgattcggaacttaacggttatcgtgttggagattatatcacagactatgcactttctaagtctgcttacgaagcttttttaaactctcgtttagataaagaaggttacaaacttcaacatcgtattagcacgaatgtacgacaaaaccttcaaattgataaattgattttcaattatgactttaatgaggaaaatatttactaccaaatcgggaatatccgtccactattaagtcgctcatcagctgaagtagaatctgacatcattacagaacgctactatgtttctaaaaatgctaaaagtttagcacgtacagaatcaaccatttcgattaaaatggttgatgccaaaactgaacaaccgctatttaaccacacattaactggttatcaattggcaactgtctcccatgtctataacagactctttgaagaaaatcttatcccaactacaaaatcaggagaaagatattttattcaaaatatgaaaaaaacagctgaacaagaatatactgtttacctttcagaaacaccttattctaaagagaacgctcccgtaatttcttatgatgcaagacctgttgattgggattatcactcaggcgcttcaggatcacttgaaaatcagcctaacatctatactgaagaagattcaactgaatttttgggtaataaaccacaagcagcttgttatccaaacaaacaatttgcttgcgaaaatactgactctaaatacaactatagctatttagaaaaatag

SEQ ID NO: 81 - DNA, 2280 bp, Streptococcus agalactiae
atgaatcctttaataattggaatgaatgataaacaagcagaagcggtacaaacgacagacggaccgcttttgattatggcaggagctggctctggaaaaacacgtgttctgactcatcgtattgcttatttaatagatgaaaaatatgttaatccttggaatattttagcgattacttttactaataaagcagcgcgtgaaatgcgtgaacgtgctatcgccttgaatccagctacccaagatactttgattgcaacttttcatagtatgtgtgttcgtattttacgtcgtgaagctgattatattggatataatcgtaactttacaatcgttgatccaggtgagcagcgtactttaatgaagcgaatcattaagcaattaaatttggacacaaaaaagtggaatgaacgttcaattttaggtacaatctctaatgctaaaaatgaccttcttgatgaaattgcatatgagaagcaagccggagatatgtatacacaggtaattgctaaatgctataaagcttatcaagaggaattacgtagaagtgaggccatggatttcgatgacttgattatgatgacacttcgattatttgatcagaataaagatgttttggcctattaccaacagaggtatcaatatatccatgtagacgagtatcaagatactaaccacgctcaataccaattagttaagttattagcttcgcgtttcaaaaatatttgtgttgttggtgatgccgatcaatccatttacggatggcgtggagctgatatgcaaaatattcttgattttgaaaaggactatccgcaagccaaagttgtattattagaagaaaattatcgatcgactaagaaaatacttcaagctgctaataatgtgattaatcataataaaaatcgccgtcccaaaaaattatggactcaaaatgatgaaggtgagcaaattgtatatcatagagctaacaatgagcaagaagaagccgtttttgtagcatcaactattgataacatcgttcgagaacaaggaaaaaatttcaaagattttgccgttctttatcgtacgaatgcgcaatctcgtactattgaggaagcacttttaaaatccaatattccatatacaatggttggtggaacaaaattctatagtcgtaaagaaattcgagatgttattgcttatctcaatatccttgcaaatacttctgataatatttcttttgagcggattgtaaatgaacctaaaagaggggttgggccaggcactttagaaaaaatacggtcatttgcctatgaacagaacatgtctcttcttgatgcctcttcaaatgtcatgatgtcgcccttaaaagggaaggctgctcaagctgtttgggatttagctaatctgattttgactctacgtagtaagctagatagtttaactgtaacggagattacagaaaacctactggataagacaggatatctagaagcacttcaagttcaaaatacattagaaagtcaagcgcgtattgaaaatattgaagaattcttgtcagtgactaaaaattttgacgataaccctgagattacagtagagggtgaaactggtttagatcgtctatcgcgttttttaaatgatttagctttaatagcagatactgatgatagcgccactgaaacggctgaggtcactttaatgacattacatgctgccaagggtctagaatttccagttgttttcttaatcggtatggaagaaggagtatttcctttatcgcgtgcaatagaggatgctgatgaattagaagaagagcgtcgtttagcttatgtcgggattacgagagcagaacaaatacttttccttaccaatgctaatacccgtactttatttggtaaaactagttataatagaccaacccgttttatacgtgagattgatgatgagctgatacaacatcaagggttggctcgaccagttaattcttcatttggtgtgaaatattcaaaagaacagcctacacaatttggtcaaggaatgagtcttcaacaagcgcttcaggcacgtaaaagtaattcacaacctcaagtaactgcccaactccaggctcttaacgcgaacaatagccatgagacatcatgggagattggtgatgttgcaactcataaaaaatggggggacggtacggtgcttgaagtttcaggtagcggaaagactcaagagttaaaaataaattttccaggtattgggttaaagaaattattagcgagtgtcgctcctattagtaaaaaggaaaactaa

SEQ ID NO: 82 - DNA, 393 bp, Streptococcus agalactiae
atgaaattatacgttcaattaatggttattttaaccttttcattcgctggtgaggttctatctactatattcaacttacctgtaccaggtagtattattggattaatattactattcctagcgttaaaatacaaaatcatcaggctcaggcatattgatgccgtggggaattttctattagcaaatatgaccattttatttttaccaccagcagttggactgatggagcactttcaagacataaaaccctatctttttgggatagctatcattatcttaggagcgctatttctcaatattctaactattggactggtatcccaatggatcaaaaagagatatgaaggagattatccagaaattggaggtaaaaatggcaactttaacgaataa

SEQ ID NO: 83 - DNA, 474 bp, Streptococcus agalactiae
atgatttttgtcacagtggggacacatgaacagcagttcaaccgtcttattaaagaagttgatagattaaaagggacaggtgctattgatcaagaagtgttcattcaaacgggttactcagactttgaacctcagaattgtcagtggtcaaaatttctctcatatgatgatatgaactcttacatgaaagaagctgagattgttatcacacatggcggtccagcgacgtttatgtcagttatttctttagggaaattaccagtcgttgttcctaggagaaagcagtttggtgaacatatcaatgatcatcaaatacaattttttaaaaaaattgcccacctgtatcccttggcttggattgaagatgtagatggacttgcggaagtgttgaaaaggaatatagctacagaaaaatatcagggaaataatgatatgttttgtcataaattagaaaaaattataggtgaaatatga

SEQ ID NO: 84 - DNA, 762 bp, Streptococcus agalactiae
atggtgatgaaaatcatagagttaaaagaagcaaccgtacaagtcagtaatggtttagcagaaatgaaaacgatattagaccatgttaatttgagtatttatgaacatgacttcattacaatattgggtggaaatggagctggaaaatcaacgctttttaatgtaattgcaggtaccttgatgttaagcggtggaaatatttacatcatgggacaagatgttactaatttaccagcagaaaaacgagctaaatatttatcacgggtatttcaagatccgaaaatgggaacagcacctaggatgacagttgctgaaaatttattagttgctaaatttcgaggtgaaaagagaccgttagttcctagaaagattactaactataccgaagaatttcaaaaattgattgctagaactggtaatggacttgatcgccatttagagacacctacaggtttattatcaggtggacaaagacaagcacttagtttattaatggcaactttgaaaaaaccaaatctgttattattggacgaacacacagcagcgcttgatcctagaacaagtgtttcgcttatgggcttgactgatgagtttatcaaacaagattcgttgactgccttaatgattacacatcatatggaagatgctctcaaatatggaaatcgtatattagtaatgaaagatggcaagattgtcagagatttaaatcaggcacaaaaaaacaagatggctatagctgactattatcaattatttgattaa

SEQ ID NO: 85 - DNA, 3219 bp, Streptococcus agalactiae
atggaaatcaaaaagaaacatcgtattatgctttattcagcccttattttaggaacaatattggttaacaatagttaccaagctaaagctgaagagcttaccaaaactacctcaacgtcccaaataagagatactcaaactaataatattgaagttctccagactgaaagtaccactgtcaaagagactagcaccacaaccacacaacaagatctgtctaaccccacagcttcaaccgcaactgcaacagccactcatagcacaatgaaacaagtagtagataatcaaactcaaaataaggagctggtgaaaaacggagattttaatcaaactaaccctgtatctggaagctggtcacatacaagcgctagggaatggtctgcttggattgataaagaaaatactgctgataaatcacctattatccaacgtaccgaacaaggccaagtaagcctatccagcgacaaaggctttagaggtgctgtaacacaaaaagtgaacattgatcccactaaaaaatatgaggtcaagtttgatattgaaacaagtaacaaggctggacaagctttccttcgtattatggagaaaaaagacaacaatacgcgactttggctttctgagatgaccagcggtactactaacaaacataccttaacaaagatatataacccaaagttaaatgtctccgaggtgacacttgaactttattatgaaaaaggaactggttctgctacttttgataatatatcaatgaaagcaaaaggccctaaagactcagagcatccacaacccgtcacaacacaaattgaagaaagcgttaatacggctttaaacaaaaattacgtttttaataaagctgactaccaatacactctaaccaatccgtctctcgggaaaattgttggtggaatattgtatccaaacgctactggttcaacaactgttaaaatatctgataaatctggtaaaataattaaagaagtaccgttatcagttacagcttcaacagaagataagtttacaaaactcctcgacaaatggaacgacgtgactattggtaatcatgtttacgatactaatgattcgaacatgcaaaagattaatcagaaattagatgaaactaacgccaaaaacatcaaaactatcaaactggattctaatcacactttcctttggaaagatttagataatctcaataattcagcacagttaaccgctacttatcgtcgtttggaagatttagctaaacaaatcaccaatccccactctactatttacaaaaatgaaaaagctattcgtactgtaaaagagagtctggcttggcttcatcaaaacttctacaatgttaataaagatatagaaggctctgccaattggtgggattttgaaatcggtgtccctcgctcaattacagctaccctagctctcatgaataactacttcactgacgctgaaataaaaacttataccgacccaattgaacactttgttcctgatgcaggatatttccgtaaaacgcttgacaatccatttaaagcccttggtggtaatctagtcgatatggggcgcgttaaaatcattgaaggtttacttcgtaaagacaatactattatcgaaaaaacttctcattctctaaaaaatctttttactactgctactaaagctgaaggtttctatgctgacggttcttacatcgaccatacaaatgttgcttatactggcgcctatggtaatgttctgatagatggtttgacacaattgctgcctatcattcaagaaactgactataaaatctctaatcaagaacttgatatggtttataaatggattaatcaatcatttttacctttaattgtaaaaggtgagttaatggatatgagtcgtggacgctcaattagtagagaggcagcttcttcgcatgcggctgcagttgaagttctcagaggtttcctcagattggctaacatgtctaatgaagagcgaaacttagacctcaaatcaactattaaaacgattatcacttcaaataaattctacaatgtcttcaataacctcaaatcgtattccgatattgccaacatgaataagatgcttaatgacagtacagtcgctactaaacctttaaaaagtaatttatcaacctttaatagcatggaccgcttagcttattataatgccgagaaagactttggtttcgcgctttcattacattctaaacgtaccctcaactatgaaggaatgaatgatgaaaatacacgtgattggtataccggagatggtatgttctatctttataatagtgatcaatctcattatagtaatcatttttggccaaccgtcaatccttataaaatggctggaacaactgaaaaagatgctaagcgtgaagataccactaaggaattcatgagcaaacatagcaaagacgctaaagaaaaaaccggtcaagttacaggaacatctgactttgttggttccgtcaaacttaatgatcactttgctcttgccgctatggattttactaactgggatcgcaccttaacagcacaaaaaggttgggttatcttaaatgataagattgtctttttaggtagcaacatcaagaatactaacggcattggaaatgtttctacaacaattgatcaacgaaaagacgattctaaaacaccttatactacatacgtcaatggaaaaactattgatttaaaacaagcaagttctcaacaatttacagatacaaaaagtgtctttttagaatcaaaagaacctggtcgcaatattggttatatcttctttaaaaatagcactattgatattgaacgcaaagagcaaacaggtacttggaacagcattaatcgtacttctaaaaatacctcaatcgttagcaatccttttatcactataagccaaaagcatgacaacaaaggtgatagctatggttacatgatggttccaaacattgatcgcacaagttttgataaattagccaacagcaaagaagtagaattactagaaaatagttcaaaacaacaagttatctatgataaaaacagtcaaacttgggctgttatcaaacacgataatcaagagagtctcattaacaatcaattcaaaatgaataaagcgggactttacctagtacaaaaagttggtaatgactatcaaaatgtctattaccaacctcaaaccatgacaaaaacagaccaattagctatctaa

SEQ ID NO: 86 - DNA, 234 bp, Streptococcus agalactiae
atgcattctttttctaatcctggatatccttatgataatgccgtaactgaagcatttttcaagtatttaaagcatagacaaatcaaccgaaaacattatcaaaatatcaaacaggttcaattagactgctttgaatacattgagaatttttataacaattacaacccacatacggctaatctaggactaacccctaatcagaaagaagaaaattattttaacgcaataaaataa

SEQ ID NO: 87 - DNA, 2469 bp, Streptococcus agalactiae
gtgaagaaaacatatggttatatcggctcagttgctgccattttactagctactcatattggaagttaccaacttggtaagcatcatatgggtctagcaacaaaggacaatcagattgcctatattgatgacagcaaaggtaaggcaaaagcccctaaaacaaacaaaacgatggatcaaatcagtgctgaagaaggcatctctgctgaacagatcgtagtcaaaattactgaccaaggctatgtgacctcacatggtgaccattatcatttttacaatgggaaagttccttatgatgcgattattagtgaagagttgttgatgacggatcctaattaccgttttaaacaatcagacgttatcaatgaaatcttagacggttacgttattaaagtcaatggcaactattatgtttacctcaagccaggtagtaagcgcaaaaacattcgaaccaaacaacaaattgctgagcaagtagccaaaggaactaaagaagctaaagaaaaaggtttagctcaagtggcccatctcagtaaagaagaagttgcggcagtcaatgaagcaaaaagacaaggacgctatactacagacgatggctatatttttagtccgacagatatcattgatgatttaggagatgcttatttagtacctcatggtaatcactatcattatattcctaaaaaggatttgtctccaagtgagctagctgctgcacaagcctactggagtcaaaaacaaggtcgaggtgctagaccgtctgattaccgcccgacaccagccccaggtcgtaggaaagccccaattcctgatgtgacgcctaaccctggacaaggtcatcagccagataacggtggctatcatccagcgcctcctaggccaaatgatgcgtcacaaaacaaacaccaaagagatgagtttaaaggaaaaacctttaaggaacttttagatcaactacaccgtcttgatttgaaataccgtcatgtggaagaagatgggttgatttttgaaccgactcaagtgatcaaatcaaacgcttttgggtatgtggtgcctcatggagatcattatcatattatcccaagaagtcagttatcacctcttgaaatggaattagcagatcgatacttagctggccaaactgaggacaatgactcaggttcagagcactcaaaaccatcagataaagaagtgacacatacctttcttggtcatcgcatcaaagcttacggaaaaggcttagatggtaaaccatatgatacgagtgatgcttatgtttttagtaaagaatccattcattcagtggataaatcaggagttacagctaaacacggagatcatttccactatataggatttggagaacttgaacaatatgagttggatgaggtcgctaactgggtgaaagcaaaaggtcaagctgatgagcttgctgctgctttggatcaggaacaaggcaaagaaaaaccactctttgacactaaaaaagtgagtcgcaaagtaacaaaagatggtaaagtgggctatatgatgccaaaagatggtaaggactatttctatgctcgtgatcaacttgatttgactcagattgcctttgccgaacaagaactaatgcttaaagataagaagcattaccgttatgacattgttgacacaggtattgagccacgacttgctgtagatgtgtcaagtctgccgatgcatgctggtaatgctacttacgatactggaagttcgtttgttatcccacatattgatcatatccatgtcgttccgtattcatggttgacgcgcgatcagattgcaacagtcaagtatgtgatgcaacaccccgaagttcgtccggatgtatggtctaagccagggcatgaagagtcaggttcggtcattccaaatgttacgcctcttgataaacgtgctggtatgccaaactggcaaattatccattctgctgaagaagttcaaaaagccctagcagaaggtcgttttgcaacaccagacggctatattttcgatccacgagatgttttggccaaagaaacttttgtatggaaagatggctcctttagcatcccaagagcagatggcagttcattgagaaccattaataaatctgatctatcccaagctgagtggcaacaagctcaagagttattggcaaagaaaaatactggtgatgctactgatacggataaacccaaagaaaagcaacaggcagataagagcaatgaaaaccaacagccaagtgaagccagtaaagaagaaaaagaatcagatgactttatagacagtttaccagactatggtctagatagagcaaccctagaagatcatatcaatcaattagcacaaaaagctaatatcgatcctaagtatctcattttccaaccagaaggtgtccaattttataataaaaatggtgaattggtaacttatgatatcaagacacttcaacaaataaacccttaa

SEQ ID NO: 88 - DNA, 921 bp, Streptococcus agalactiae
atgaaaaaaggtttttttctcatggctatggttgtgagtttagtaatgatagcagggtgtgataagtcagcaaaccccaaacagcctacgcaaggcatgtcagttgtaaccagcttttacccaatgtatgcgatgacaaaagaagtatctggagacctcaatgatgtgaggatgatccaatcaggtgcaggcattcattcctttgaaccgtctgtaaatgatgtggcagctatttatgacgcggatttgtttgtttaccattcacataccttagaagcttgggcaagggatctagaccctaatttaaaaaaatcaaaggttgatgtgtttgaagcgtcaaaacctttgacactagatagagtcaaagggctagaagatatggaagtcacacaaggcattgaccctgcgacactttatgacccacatacctggacggatcccgttttagctggtgaggaagctgttaatatcgctaaagagctaggacgtttggatcctaaacacaaagacagttacactaaaaaggctaaggctttcaaaaaagaagcagagcaactaactgaagaatacactcaaaaatttaaaaaggtgcgctcaaaaacattcgtgacgcaacacacggcattttcttatctggctaaacgattcggcttgaaacaacttggtatctcgggtatttctccagagcaagagccctctcctcgccaattgaaagaaattcaagactttgtcaaagaatacaacgtcaagactatttttgcagaagacaacgtcaatcccaaaattgctcatgctattgcgaaatcaacaggagctaaagtaaagacattaagtccacttgaagctgctccaagcggaaacaagacatatctagaaaatcttagagcaaatttggaagtgctctatcaacagttgaagtaa

SEQ ID NO: 89 - DNA, 3453 bp, Streptococcus agalactiae
ttgcgtaaaaaacagaaactaccatttgataaacttgccattgcgcttatgtctacgagcatcttgctcaatgcacaatcagacatcaaagcaaatactgtgacagaagacactcctgctaccgaacaaaccgtagaaactccacaaccaacagcggtttctgaggaagcaccatcatcaaaggaaactaaaaccccacaaactcctagtgatgcaggagaaacagtagcagatgacgctaatgatctagcccctcaagctcctgctaaaactgctgatacaccagcaacctcaaaagcgactattagggatttgaacgacccttctcaggtcaaaaccctgcaggaaaaagcaggcaagggagctgggactgttgttgcagtgattgatgctggttttgataaaaatcatgaagcgtggcgcttaacagacaaagccaaagcacgttaccaatcaaaagaagatcttgaaaaagctaaaaaagagcacggtattacctatggcgagtgggtcaatgataaggttgcttactaccatgactatagtaaagatggtaaaaccgctgtcgatcaagagcacggcacacacgtgtcaggaatcttgtcaggaaatgctccatctgaaacgaaagaaccttaccgcctagaaggtgcgatgcctgaggctcaattgcttttgatgcgtgtcgaaattgtaaatggactagcagactatgctcgtaactacgctcaagctatcagagatgctatcaacttgggagctaaggtgattaatatgagctttggtaatgctgcactagcttacgccaaccttccagacgaaaccaaaaaagcctttgactatgccaaatcaaaaggtgttagcattgtgacctcagctggtaatgatagtagctttgggggcaagacccgtctacctctagcagatcatcctgattatggggtggttgggacacctgcagcggcagactcaacattgacagttgcttcttacagcccagataaacagctcactgaaactgctacggtcaaaacagccgatcagcaagataaagaaatgcctgttctttcaacaaaccgttttgagccaaacaaggcttacgactatgcttatgctaatcgagggacgaaagaggatgattttaaggatgtcaaaggtaagattgcccttattgaacgtggcgatattgatttcaaagataagattgcaaaagctaaaaaagctggtgctgtaggagtcttgatctatgacaatcaggacaagggcttcccgattgaattgccaaatgttgatcagatgcctgcggcctttatcagtcgaaaagatggtctcttattaaaagacaatccccaaaaaaccatcaccttcaatgcgacacctaaggtattgccaacagcaagtggcaccaaactaagccgcttctcaagctggggtctgacagctgacggtaatattaagccagatattgcagcacccggccaagatattttgtcatcagtggctaacaacaagtatgccaaactttctggaactagtatgtctgcgccattagtagcgggtatcatgggactgttgcaaaagcagtatgagacacagtatcctgatatgacaccatcagagcgtcttgatttagctaaaaaagtattgatgagctcagcaactgccttatatgatgaagatgaaaaagcttatttttctcctcgccaacaaggagcaggagcagtcgatgctaaaaaagcttcagcagcaacgatgtatgtgacagataaggataatacctcaagcaaggttcacctgaacaatgtttctgataaatttgaagtaacagtaacagttcacaacaaatctgataaacctcaagagttgtattaccaagcaactgttcaaacagataaagtagatggaaaacactttgccttggctcctaaagcattgtatgagacatcatggcaaaaaatcacaattccagccaatagcagcaaacaagtcaccgttccaatcgatgctagtcgatttagcaaggacttgcttgcccaaatgaaaaatggctatttcttagaaggttttgttcgtttcaaacaagatcctaaaaaagaagagcttatgagcattccatatattggtttccgaggtgattttggcaatctgtcagccttagaaaaaccaatctatgatagcaaagacggtagcagctactatcatgaagcaaatagtgatgccaaagaccaattagatggtgatggattacagttttacgctctgaaaaataactttacagcacttaccacagagtctaacccgtggacgattattaaagctgtcaaagaaggggttgaaaacatagaggatatcgaatcttcagagatcacagaaaccatttttgcaggtacttttgcaaaacaagacgatgatagccactactatatccaccgtcacgctaatggcaagccatatgctgcgatctctccaaatggggacggtaacagagattatgtccaattccaaggtactttcttgcgtaatgctaaaaaccttgtggctgaagtcttggacaaagaaggaaatgttgtttggacaagtgaggtaaccgagcaagttgttaaaaactacaacaatgacttggcaagcacacttggttcaacccgttttgaaaaaacgcgttgggacggtaaagataaagacggcaaagttgttgctaacggaacctacacctatcgtgtccgctacactccgattagctcaggtgcaaaagaacaacacactgattttgatgtgattgtagacaatacgacacctgaagtcgcaacatcggcaacattctcaacagaagatcgtcgtttgacacttgcatctaaaccaaaaaccagccaaccggtttaccgtgagcgtattgcttatacttacatggatgaggatctgccaacaacagagtatatttctccaaatgaagatggtacctttactcttcctgaagaggctgaaacaatggaaggcgctactgttccattgaaaatgtcagactttacttatgttgttgaagatatggctggtaacatcacttatacaccagtgactaagctattggagggccactctaataagccagaacaagacggttcagatcaagcaccagacaaaaaaccagaagctaaaccagaacaagacggttcaggtcaaacaccagataaaaaaacagaaactaaaccagaaaaagatagttcaggtcaaacaccaggtaaaactcctcaaaaaggtcaaccttctcgtactctagagaaacgatcttctaagcgtgctttagctacaaaagcatcaacaagagatcagttaccaacgactaatgacaaggatacaaatcgtttacatctccttaagttagttatgaccactttcttcttgggattagtagctcatatatttaaaacaaaacgccaaaaagaaactaaaaaatag

SEQ ID NO: 90 - DNA, 1212 bp, Streptococcus agalactiae
tttagtgtaacctattcacagtctgaacgtacggttgttttctcttttggagaaataacatttagtaggagtcgctggacaaatggctttgaaactagaataccagtagatgagtggttaggtcttgaaaaatataagagatattcaatagaattcttatatcatgttgcaaaattggctacaatgatgccttatcgtcaagtttgcaaagtaatagatagcactttgcaaacaatcataacaaaagactgtgttttaaaagcagtaaaatttgtagaaaaattgttaaaagaaaaagaacgctatcgtttttatttggaagagccacccgaacgtaaaaaagtgaaaaaactgtatgttgagggtgatggagtcatgattaaaagcacagattctagagaggaaagaaggtatttagatttaacacattttgttattcatacaggctcaaaaaaagtttctactaaaagatatgaattgcaggacaagcacgaaatattacagcttaattatgataaagctaaatataatcttttagattatatttataataactatgaagtagatgacgatactattttaatcactaactctgatatgggtaaaggctatactagtagagtttttaaggaattaggaaaagcacttaaggtaaagaaacatgagcatttttgggatatctatcatgttaaagaaaagttaagttcataccttagaaaatatccaattgaattaaccgattttgctttagatgcggtaaaaaaatataattctgataagcttgaattagtttttgatactgttgaatcactgatttgtgatgaacttgaagatcaagaatttcagaagtttaagaaaaaagtattaaataatttcaaatatataaaaccagctcatcttagaaatctttcaaatcgtggtattggtatcatggaatcacaacacagaaagataacgtatagaatgaagcgacgtggcatgtattggtcaaagtggggaatctccacaatggcaaatatgattatacttgaaagagctaacggtttacgagaattatttttcggttcttggagaaaggtatacagtgagtataaagaaggttcatttagtgcagggcgactttttaaaaagacagatgaattagataaattttctaagccccttctaaaaaatggcagaaaatggagtataacaggaatcaaaacaaaatag

SEQ ID NO: 91 - DNA, 837 bp, Streptococcus agalactiae
aaagcaagcagcggtgattatggcacaaaaagggaaataatcactgctaataaggataaatacagcatttcaaagatgtgtcgctggctgaatatgccacgctcaagttattactatcaagccgtggagtcagtatctaaaacggagtttgaagaaactattaaaagaatttttctcgatagcgagtctagatacggatccagaaaaatcaaaatatgcttgaataacgaaggtatcacactttcacgtcgtcggattcgacgcattatgaagcgactcaatttggtttctgtttatcagaaagccaccttcaaaccacattctagaggcaagaatgaagcccctattcccaaccacttagacaggcaatttaagcaagaaagaccactacaagccttagtcactgacttaacctatgttcgtgtaggcaatcgttgggcttatgtttgcctcatcattgacctatacaaccgtgaaatcatcggcctgtctcttggttggcacaagaccgctgaactcgttaagcaagccatacaaagcatcccttacgccctgaccaaagtcaagatgttccattcagatcgtggcaaagagtttgataatcagttaattgatgaaatattggaagcctttggaatcacacgttcgcttagtcaggctggttgtccttatgacaatgccgtagctgaaagtacgtatcgtgctttcaaaattgaatttgtttatcaagaaacctttcaatcgctggaagaactagctcttaagactgaaaaggcaacacttttctgtacaacatttataaagtgttgccttttcaggtttttaccaatgctataa

SEQ ID NO: 92 - DNA, 315 bp, Streptococcus agalactiae
atgaagacaagaaatcgtaaaggtggttatttagcgaatactgcaaatgagtacatcgactctaaacaggcaattcattgcttgagtgtagaacttgaaccgcaaattaggtttgaagagggtcagcctactggggagattatcgcttataaggcttggttctctcaaaaagggcttccgccttttatggtgaagtttgaaaatgaagtgacactaccagcatatatggtaatggtgcaatttgagaatcttcaagcttgtgaggttgggttcaatgtttatttcaaggcagacaatctcaaggaggtcaaataa

SEQ ID NO: 93 - DNA, 6201 bp, Streptococcus agalactiae
ttgtccacttttgattcagttacaggaaggaccaatcacttggaagcttatgaagggctgaacctttctgaaaaatttgccattttaagtcactttgacaaacttagaaatgagctgcagacaccatctattcagctaggggagtttgatagggaaatggaagctttttcaatcactttgggaaatgaactgttgggttatttagaggcaaatggcagcccctatgagttgaagcgagaattgaatcaggccgaaatgatggcagtccttgagcttagccgtcaactggttgcaaaattttctacaaaactagaggagctgggaattgatttgggttcatttcaaccagaccaagtcaacatcttattggatgccgttggtcgttttcgcttgaaaaatgcggacattgctttattaggcggttatccaaaagcgagtgtttcccagctagctcttgcgacagaactcctccagatgggactaagtcatgataaggtagaatttttcttaaccagtcagcttcagttagaggatatgcgacaggtcgcttttgctttcctacatgaaagcttgaccagagaagaagcagagcaatttgaaacagaccgctttcgtcatacaagcttaaactttcgagaatggcgagaacttctagaaaagcaagagccagaaatggtggagatgtcagacgtcagcccgcttgttcgggaagtcttgcatcattatccacttggttcaagggtcacttataaaggacaggagtttgagatcttgtctattgaagctgcggacatggataatctgattcgaatagagcttcaaaatgatttttcatatctcattgaacaaaatcccgttctctatttccaaaacttggcagaaatcaggcaagttcttcatttgtctcgttcggaaattgtagaaagagaggaacaacctgaggaagaatggactctcttttcgtttatggatgaggggacagaggataacgaaaaggaacctgagattgtttttgaatctaccgataaagttgttacattagatagtcagccagcacaagtaagtgagactatatccgaatcagttcctgaaaccaaagaggtgattgaagcagaacaagcaatagcagttgattttagctttcctgaagatttgactaatttttaccccaaaacagctagggataaagtagtggcgaatctcgtagctattcgtcttgtaaaagaattagaaagtgctaatcaatcagcaacacctaatgaacaagaaattcttgccaaatatgtgggttggggtggtcttgccaatgaattctttgatgagtacaatccgaagttttctaaggaaagagaggagttgaaaactctcgtttctgataaagagtattccgatatgaaacaatcatctctaacggcctactatacggatccgcttttaattcgtcagatgtggtctaagttagaacaagacggctttagtggtggaaaaatattagacccatcaatgggaacagggaatttctttgcggctatgccagctcatttgagggaaaagagtgagctgtgtggggttgagttagatactatcacaggagcgatagctaagcagcttcattcaaatgtccatattgaagtaaagggatttgagacggttgcttttaatgataatagttttgatttggttatttcaaatgttccctttgccaatatccgtatcgcggataatcagtacgataagccctatatgattcatgactactttgtcaagaaatctcttgatttggtacatgatggtgggcaagtagccattatttcctccacaggaaccatggacaaacggacagaaaatattctccaagatattcgtgagacgacggattttcttggtggcgtgcgtttgccagatacggcttttaaggccattgcaggtacaagtgtgacaacggatatgcttttctttcagaaacatctgaacaaaggctatcaagcagatgacattgccttttcaggttctgttcgttatgacaaggacgagcgtatttggctcaatccctactttgatggggagtataatgcccaggttcttggaaggtatgagattaaaaactttaacggtggaacactttcggttaaggaaacgactgataacctgattgcgagtgttcgagaagccttgcaacatgtaaaagcaccaagggttattgataaaacagaagtcatgattaactcggatgtgattgcaagacaggtcatagataccaccattccacctgaaattagagaaaaccttgaacaatatagctatggttacaaaggttctaccatttattatcgtgataataaggggattcgtgttgggacaaaaacggaggaaattagctattatgtggatgatgagggaaactttcaggcttgggagtccaagcattcacaaaaacagattgaccgttttaataacttagaagtcacagatagcacagctcttgatgtttatgtgactgaagaacctgcgaaacgtgggcaatttaaaggatatttcaaaaaggcggttttttatgaagctcctttgtctgaaaaagaagtggcacggattaaaggaatggtagatattcgcaatgcctatcaagaggtcattgctattcaacgcaattatgattacgataagaatgagtttaaccgcttgttaggaaacctcaatcgcacctatgatagctttgtcaaacgctatggctttttgaacagtccagttaaccgaaatttatttgatagtgatgataagtattcgcttttagctagtctcgaagatgaaagtcttgacccaagtgggaagacggtcatttatacgaagtcactggcttttgaaaaagccttggtccgtcctgaaaaaatggttaaagaggtgtcaaccgctcttgatgcactcaactccagtcttgcggatggtcgtggagttgactttgattacatggcttccatctatcaaacagcatctaaggcagctttgattgaggagctgggagatcagattataccagatccagaaagttatttaaaaggacagctgacctatgtatctcgccaggagtttttatcaggagatattgtgacaaaattagaagttatggacttactgttaaagcaagacaatcatgattttaactgggcgcattatggtaatttgttagaaagtgttcgtccagcacgagtgatgttggcagatattgattatcgaattggttcacgttggattcctttagctgtttatggaaaatttgtccaagaagcctttatggggaagaattatgacttaacggctacagaagtggaagaggtcctctctgtcagcccgattgatgggacgatggaatttcggacacggtttgcctatacctactcaacagcgacggatagaagcctgggtgtagcaggctcacgctatgatagtggtcggaaaatctttgagaatctgcttaactccaatcagccaaccatcacgaagcagattcaagagggagataagaaaaagaatgtgacagatgtggagaagacaaccgttctgcgtgctaaagaagcacaaatccaagacctctttcaagattttgtcgcaagctatcctgaagcccaacagatgattgaggatacctataatagtctctataatcgtaccgtctctaaagtttatgatggcagccgtttggagattgatggtttggctcaaaatatttcgcttcgtcctcatcaaaaaaatgccattcagcgaatcgtggaggaaaaacgggctcttttagctcatgaagtgggttcaggcaaaactttaaccattcttggagcaggctttaaactgaaagagttaggtatggtacataaaccgctttatgtggtaccttctagcttgaccgctcagtttggtcaagaaatcatgaagttcttcccaacgaagaaagtctacgtgacgacaaagaaagattttgccaaagctcggcgcaagcagtttgtctcacgtattattacaggggattacgatgccattgtcatcggggactcccagtttgaaaaaatccccatgagtcaggaaaaacaggtgacttatattcaagataagttggaacaattacgggagataaagcaaggaagcgatagtgactacacagtcaaagaagcggagcgttcgattaaaggtttggaaaaccaattggaagaactccagaaactagatcgagatacctttattgaatttgaaaatcttggcattgattttctctttgtggacgaagcccatcatttcaaaaatattaggccgattactggtctgggaaatgtagcgggaattaccaacacgacttctaaaaagaacgtggatatggaaatgaaagtgagacagattcaggcagagtatggagatagaaatgtcgtttttgcgacaggaacgccggtgtctaattccattagtgaactctatactatgatgaactatattcagccagatgtcctagaacgctaccaagtttctaactttgactcctgggttggagcttttggcaatatcgaaaattcgatggagctagcgccaacaggagataagtatcaacccaagaaacggtttaaaaagtttgtgaatctacctgaactcatgcggatttataaagaaaccgctgatattcaaacgtcagatatgttggatttacctgtacctgaagccacagtcattgcggtggaaagtgaactcacagaagctcagaaaaactaccttgaagaattggtggaccgttcagatgcgattaaatcaggaagcgttgaccctagtgtcgataacatgttaaaggtgataggcgaagccagaaagctagccattgatatgcgtttgattgaccctgcctataccttatctgacaatcagaagattatgcaagtagtggataacgtggaacggatttaccgtgagggcaaaggagataaggctacacagatgattttctctgacattggcacgcctaaaagtaaagaagaaggatttgatgtctataatgaattgaaagccctcttagttgaccgaggaattccaaaagaagaaattgcctttgtccatgacgctaatacggatgagaagaaaaattctttgtcacgaaaggtcaatagtggggaagtaaggattctcatggcttcaactgaaaaaggaggaacaggattaaacgtgcaagcacgcatgaaagctgttcaccatttagacgttccttggcgtccctcagacattcagcaacgcaatggacgtttgattagacaaggaaatcaacatcagaatgtagagatttatcattatattaccaaaggttcatttgataactatttgtgggctacacaagagaataagttgcgttatattaaacaaattatgacttcaaaagatcctgttcggtcagcagaagatattgacgagcaaaccatgaccgcttcagatttcaaagcgttagctactggcaatccctatctcaaactcaaaatggagttagagaatgaattgaccgtcttagaaaatcagaaacgtgctttcaatcgctccaaagatgaatacaggcacactatttcctattgcgagaaaaacttacctgttatggaaaaacgattaaggcagtatgacagagatattgagaaatcacaagcaacgaagaatcaagagtttatcatgcggtttgataaccagacaattgacaatcgcagcgaagctggggattatttacgaaaactcatcacctataatcgttccgaaaccaaagaagtcagaaccttagcgacctttagaggctttgagcttaaaatggctacacgaagtcctggtgaacccttgtctgacatggtgtctctaactatttcaggggataaccagtattcagtttcccttgatttaaaatcagacgtgggaacgattcaacggattaacaacgccattgaccatatcctagaggataaggaaaagacagaagagatgacaaacaacctcaaagataagctagcagtcgcaagagttgaagttgagaaagtctttgcaaaggaagaggaatatcagttggtaaaggccaagtatgatgtacttgccccattagtggaaagagaagcagacttagaagaaattgacgtagcactttcccaatttagtagctctgacccatgcttgaaaaaagatcaacagttagtccttgacatttaa

SEQ ID NO: 94 - DNA, 4905 bp, Streptococcus agalactiae
atgaccacaaaatgcaatcatcattttctcatcaatcaggagaaaggcgaaaagtatgtttttcgtaaaagtaagcaatatcgcacgctgtgttcggttgctttaggaacagttgtgatggcattcgtagctttggccggaccgatggtgcaggcggatgaagtagggagaactgttgcgacaagtgtacagacggaaacgaatcctgcaacaaatttaaaagaaaatcagccaagtccgattgcggaacaaaaagatagtcttgcagcaaccggtcaatcaactggaacggtgacagtcactgttccacatgataaggtgacacaagctgtcgataaggcaaagaccgaaggaataaaagcagtacaagacaagccgatggacttaggcaatacagtatccgcagctgaaaccagccaacaactcaaaaaggcagaagaagatgccacaaaccaaacaacaactatttctaaaactgttgaaatctacaagtctgataaagcaacttatgaagctgaaaagaagtgggtagagaagcgtaatgaagagttaactgctgcttatgataaggcagaacaaacagggactggcttaaaccattcggttgatacgactgtttcagaattgaagtcgcaagaccaaaacgctcatgtgaccgtgaacacacaaacagtaaaatcaggagatgggacgagtgtttcaggctatcaggagtacgtcaagtctgttgcggccattgataagaagaataaagcgaacttagctgattatcggactaagaaacaagccgcagacgctgttgtggctaagaatcaactcattcaaaaagagaatgaagctgggcttgctaaggcaaaagcagaaaatgaagcgattgacagacggaataaagaagggcaaaaagctgttgatgaagcaaataaggctgggcaagccgcagtagagcaagcgaaccaagaaaaacaaaaacaggccgcaaaccgtgcttttgaaattgcgacaattaccaaacggaataaagaaagagaagaagtcgcaaagaaagaaaatgcagcgattgatgcttataatgcgaaagaatggatccgctataagcgggatttagcaaacatctcaaaaggggaggaaggctacatttcagaagcccttgcgcaggctctagatttaaatcatggcgaaccgcaggtcaaacatggtgcaggtactcgaaatccagatcgaatcatttcaaagggagatgccatgttgggtggctattctaacattcttgattcaacgggtttctttgtctacaatcactttaaaacaggtgaaacgctgaactttacctatcaaaatctgaagcatgcacgttttgatgggaagaaaattacagccataacttatgatattaccaatctggtttcaccaactggaaccaatgcggtgcagttagttgttccaaacgacccaacagaaggctttattgcttatcgcaatgatggcgctggaaattggcggacagataagatggagttccgtgtcaaagctcggtatttcttagaagacggttcacaagtgacctttactaaagaaaaaccaggtgtctttacccactcgtcactcaatcataatgatattgggcttgaatatgttaaagactcatcaggtaaatttgttcctattcatggttcaagtgtgcaagtaaccaatgagggcttagcccgttcgttaggttcaaaccgagcgagtgacttgaagttgccagaagaatgggatacgacttctagtcgctatgcttataaaggagcgattgtatcaacagtcacatcggggaatatttataccgtaacctttggccaaggagatatgccaacccaagtgggagggaagacctattggtttgctttaaatactttgccagtcgcaaaaacagtgactccctacaatccaaagactcatgtaagaccacagctggatccagttcctgaaccgataaaagttacaccagaaacttatactcctaaaatctttactcctgaaaaaccagtaacctttactccaaaatcagtagaaaaagtgccccaacctagtttgaccttaacaaaagtcacactaccaacaaatctgaagctagaaccattacccaaagctccacaaaagccaaccgttcattaccacgattacctcttaaccacaacacccgctatcgcaaaagaagtgatgaatgttgacaaagttaatcttcatggtaaacaggtggctaaggattccactgttatttatcccttgacagtagatgttttatctccaaatcgttccaagataaccagtcttatctttgaagattatctgcctgctggttatgcgtttgatatgacgaagacacaagcggagaatagcgactatgacttaacctttgataaaaataagaactttgtgaccttgaaagcgaaagatagcttacttcaaacgttgaataaagagttaaacaagtcttatcaactgtctgctccaaaactttatggttcagttcaaaatgatggggcgacttattctaatagctataaactccttattaacaaggacaccccaaacacctatacggttatttcaaacgtagttagaattcggactccaggagacggtgaaacgaccagccgaatccggcctaaaaaggacaatgaaaatgcggacggtgtgttgataaatgatacggttgttgctcttagtacaaccaatcattaccgtttgacctgggatttggatcagtacaagggggatacttcttcaaaagataccattgcacgaggattcctttttgtagatgactacccagaagaagcacttgacttggtagataaagggacagttatcaccacccttgatggtaaagctgtttcaggtatttctgtatacagctatacatcccttgataaagcaccaaaagagctacaagataaattagctcgtgcgaacatttcgccaaaaggagcgttccaggtctttgaaccggacaatcatcaagcgttttacgatacttacgttaagactgggcagtctttagcccttctcacaaaaatgaaggtaaaagatagtttgtacggtcagactgtcagatacaaaaataaagcctaccaagttgattttggcaatggctatgaaactaaggaagtcgtcaatacagtcgttcatccagagcctaagaaacaaaatctcaataaggacaaggtggacatcaatggcaaagcgatgcttgtcggctcccaaaacttctatacgctttcttgggatttagatcagtatcgtggcctacaagcggataagagtcagattgctcaaggcttttactttgtggacgattatcccgaagatgttcttcttcctgacacaaaagccattcaaattatgacgaaagacgggaaagctgttaaaggaatggagataaaaacctatcatcaactctcagatgctccaaaggaattgcaggcagctcttgccaaacgtaatatcacgcccaaaggcgcttttcaagtctttatgccaaaagatccacaagctttttataaagcttatgtgacaactggtcaaaacttgactattgtgaatccgatgacggttcgtgaagcagtatacaactcagggaagtcttatgataatgtggcctatcaagtggactttggacaggcctatgaaacgaatatagtgaccaatcacgtgccaacagtaaacccgcataagtccaataccaataaagaaggtgtgtcaatagaaggtaagacagtccttccgaatacggtcaactactataaaattgttctagattatagtcagtacaagaatatgattgtgacagatgatgtcctcgtcaaaggtttttatatggtggatgattacccagaagaagcacttactcctcatccagatgggactcaagtgatggatcagaacgggaaatttgtcagaggcctgtctgttcgaacttacgcaagtttggcagatgcaccgaaagcagtacaagaagcaatgaaatctcgaaatttcattcctaaaggagctattcaggtctttcaggcagatgacccaaaaactttctttgaaacttatgtgaaaacaggacaaaaattggttgtgacaacaccgatgacagtgaagaatgaacggattcaaacaggcggtcagtatgagaatacagcttatcagattgattttggcatcgcttatgtaacggaaacagttgtgaataatgtaccaaaattagaacctcaaaaagatgtggtcattgacttatctcaaaaagataagagtttaaacggaaaagcaatcgctttggatcaggtctttaactaccgcttggtaggttcacttatcccacgcaatcgtgcgacagccttggtggaatacagttttaaagatgactacgatgaaaagcacgatgaatataagggtgtttataaagcctatactttgcgtgatgtaaccttaaaagatggcacagtattaaagcaggggacagaagtgacgaaatacaccttacaaagtgttgataaggcaaaaggaacgattgcgattcgttttgatacagcttttttggaaaatatagctgatgaatcagagtttcaggctgagctttatcttcagatgaaacgcattgcttcaggtgatgttgaaaatacagttattcatagtgtcaatggttataatattcgctctaacacggttaagaccacaaccccacaaccagagtcaccgactcctgataacccaccgtcaccccaaccgccagttccaaccacagaatccccagttcaagctagtgtcctaccaagtacaggggaaagtcaatcccttttggcgctcattggaggaggtctcctgcttggcctcgcttacggactttctaaacgaaaaaaggagaaaaactaa

SEQ ID NO: 95 - DNA, 2109 bp, Streptococcus agalactiae
atggcaaataataatttttataatcgtgacccttttggaaatatggatgatatttttaattctctaatgggaaatatggggggctataatagtgagaataaacgatacttaatcaatggacgggaagttactcctgaagaattcagtcaatatcgtcaaactggaaaactccccggtcaagagctaaataaccaaaatactcctacaaaccaagtctctgcagatagtgttttgactaaattaggaactaatttaaccgatcaagcacgtcagcatttgctagatccagttattggacgaaacaaagaaattcaggaaactgcagaaattctagctcgtcgtactaaaaataatcctgttctagttggtgatgcaggtgttggtaaaacagctgttattgaaggtttggcacaagcaattataaatggtgatgtccctgctgctatcaaaaataaagaaatcatttcgatagatatctctagccttgaagctggcacccaatataggggtagttttgaagaaaatattcaaaatatcataaaagaagttaaggaaacaggaaatattattctcttctttgatgaaatacaccaaatattaggagccggttcaactggtggtgatagtggctctaaggggctcgcagatatacttaagcctgcactttcacgtggtgaattaacggttataggtgcaactactcaagatgaatatcgtaacaccattctcaagaatgctgccttagcacgccgctttaacgaagttaaagtcaatgcaccttctgcacaagatactttcaatatccttatggggataagaaacctctatgagcaacatcataatgttgttttacctgactctgttttgaaagcagctgtagatttatctattcaatacataccacaaagaagtctccctgataaagcaattgaccttattgatatgactgctgcacacctagctgcgcaacatcccgtaactgaccttaaatccttagaaaaagaaatcgctgcgcaaagagacaagcaagaaaaagctgtcaatactgaagattttgaagaagctcttaaggtcaagacacgcattgaagagttacaaaaccagattgataatcataccgaaggacaaaaagtcactgcaactatcaatgatatcgctatgtcaattgagcgtctaactggagttcctgtatcaaatatgggtgctagtgatattgaacgcttaaaagaacttggcaatcgtctaaaaggtaaagtcattggtcaaaatgatgctgttgaggcagttgcaagagctattcgccgaaatcgtgctggtttcgatgatggtaatcgtccgattggtagctttctatttgttggaccaactggagttggtaaaactgagctagcaaagcaattagcttttgatatgttcggatcaaaggatgctatcgttagacttgatatgtctgaatataatgatcgtactgcagtttctaagctaattggagcgactgctggttacgttggttatgacgacaatagtaatacactaacagaacgtatccgtcgaaatccttattctattgttcttcttgatgaaatcgaaaaagctgacccgcaagttatcacgcttctccttcaagttctagatgatggtcgtttaactgatggtcaaggaaacactattaactttaaaaatactgttatcattgcaacctcaaatgcaggttttggaaacgaagcatttacaggtgacagcgataaagacttgaaaattatggaacgaatttctccatatttccgtccagaatttctaaatcgtttcaatggtgttattgaattctctcacctaagcaaagatgacttaaacgaaattgtagatttgatgcttgatgaagttaaccaaacaattggcaaaaaaggaattgaccttgtggtagatgaaaatgttaaatcacacttaattgacctgggttatgacgaagcaatgggagtacgtccattgcgccgtgtcatcgagcaagaaattcgagatcgcatcacagactactatctcgatcatacagatgttaaacacctaaaagctaatttgcaagatggccaaatcgtcatttctgaaagataa

SEQ ID NO: 96 - DNA, 945 bp, Streptococcus agalactiae
atgggaagatttaaagaacttttagagagtaaaaaagctctcatcctacacggtgccttggggaccgagcttgagagtagaggttgtgatgtttctggtaaactttggtcagacaaatatctgattgaggatccagcagctattcagaccattcatgaagattatattcgtgctggcgctgatattgtgacgacatcaacttatcaggcgactttacaagggctagctcaagttggtgtctctgaaagtcaggcagaagacttgattcgcttgactgttcagttggcaaaagctgtgcgtgagcaagtttggaaaagtttgacaaaagaagaaaaatcagaaagaatctatcctttgatttctggggatgttggtccctacgctgcctttttggcggacggttctgagtacacagggctctacgatatttataaggaaggtctcaaaaatttccatcgccatcgtattgagcttcttttagatgagggtgttgaccttctggcacttgaaaccattccaaatgctcaggaggctgaggctcttattgagctacttgtcgaggatttccctcaggttgaggcttatatgtcattcacctctcaagatggtaagaccatctcagatggtagtgctgttgcaggcttggcgaaagctattgatgttagcccacaggtcgtggcgctgggcattaactgttcaagtccatcgttagttgctgatttcttgcaagcaatagcagagcagacggacaagcctcttgtgacctatccaaactctggagagatttatgatggggcaagccaatcttggcaatctagccgagatcattcacacaccctacttgaaaatacaagtgactggcaaaaacttggcgcccaagttgtcggaggttgttgccgaactagaccagctgatattgctgacctctcagaacatttgacataa

SEQ ID NO: 97 - DNA, 1173 bp, Streptococcus agalactiae
atgaaaataggaattgataagattggttttgcaaccagtcaatatgtccttgaaatgactgatttggctattgctcgccaagttgaccctgaaaaattcagcaagggattattgttagattcacttagtattacgccagttacagaagatatcgttacacttgcagcctctgcagctaatgatattttatctgatgaggacaaagaaactattgatatggtgattgtcgctacagaatcaagtatcgatcagagtaaggcggcttctgtctatgtacatcaacttttagagattcaacctttcgcaaggtcattcgagatgaaagaagcatgctatagcgcaactgctgctcttgattacgctaaattacatgtagaaaaacatccagattctaaagtattagtgatagcttcagatattgctaaatatggcattaaatctactggagaatccactcaaggtgcaggcagtatcgctatgcttattagtcaaaacccatccattctagagctaaaagaggaccgtctagcgcaaacccgtgatattatggacttttggcgaccaaattattctgatgttccttatgttaatggcatgttttcaacaaaacaatatctagatatgctaaaaactacttggaaagaatatcaaaaacgttttaatactagtctaagtgactatgctgctttttgtttccatatcccttttccaaaattagctttaaagggctttaataaaattctagataataacctagatgaacaaaagaaagctgaactacaagaaaattttgagcactctattacttatagtaagaaaattggaaattgctatactggctcattgtatctaggacttctatcgttactagaaaatagtcaaaatttaaaagcaggtgatcaaattgccttcttttcatacggtagcggagctgttgctgaaatttttaccggtcagttagtagacggctaccaaaataaacttcagagcgatcgtatggatcaactcaataaacgtcaaaaaattacagtaactgagtatgagaaactcttctttgaaaaaacaatcctagacgaaaatggaaatgccaacttcaacacctaccgtactggcactttttctctagactctatttgcgaacatcaacgtatctacaagaaaattaataattaa

SEQ ID NO: 98 - DNA, 915 bp, Streptococcus agalactiae
atgaaaagtgcttatatcttttttaatccaaaatctggtaaagatgaacaagcattggcacaagaagtaaaatcttatttaatagaacatgattttcaagacgattatgttcgtatcattacaccttcatctgttgaggaagctgtcgccttagcaaaaaaagcatcagaagaccatatcgacttggttattcctttagggggagatggcactattaataaaatctgtggtggtgtctacgctggtggtgcttatcctactatcggactagtacctgccgggaccgtcaataacttttcaaaagctttgaacatcccacaagagaggaatctcgctcttgaaaaccttctaaacggtcatgtaaagtccgtagatatctgtaaagttaacgacgattacatgattagcagtttaacacttgggctccttgctgatattgctgctaatgtcacttctgaaatgaagcgtaaattaggaccttttgctttcgtaggtgatgcctaccgtatattaaagcgtaatcgatcatattctattactcttgcttacgataataatgtacggtctttacgcacgcggttactacttattaccatgaccaattcgattgccggtatgccagccttctctccagaagcaacaattgatgatggactttttagagtctacactatggaacatattcacttcttcaaattattgttgcatctaagacaatttcgtaagggagattttagtcaagcaaaggagataaaacattttcataccaataatctgactatttcaacttttaaacgtaaaaaatcagctatccctaaagttcgtattgatggcgatccaggtgaccaattgcctgtaaaagttgaagtcatccctaaagccttaaagtttatcattcctaactcattaccataa

SEQ ID NO: 99 - DNA, 855 bp, Streptococcus agalactiae
atgacaacatttactgctaaatttattgaccaagagtgggaagtcccagtagaatcaggtcgctaccatatgattgttggggaattttgtccttatgcacaacgtccgcagattgcacgccaactgcttggtttggataaacatatttctatcagttttgtggatgatgttccaagtgatataggacttatttttagccaaccagaacaggttactggtgctaagtcgcttcgtgatatttatcatttgactgacccgacctacaaaggtccttatactatcccaattttaattgacaagactgataatcgtattgtctgtaaggaatctgcagatatgcttcgactttttactacagatttctctgatttgcatcaagaggatgctcctgtccttttcagccaagaaactgcttcacttattgataatgatattaaagacattaataataacttccaaagcttaatgtataagttagcttttcttgataaacaagcagattatgatacttatagtaaggaattcttcacttttctagatcaaaaagaacacttactaggacaacgtcctttcttgctcggagataatctaagtgaggttgatattcatttctttacaccattagtccgctgggatattgctgggcgtgatcttctactacttaatcagaaagcgctagaagactacccaaatattttttcttgggctaaaactttatacaatgactttaatttaaaaacattaaccaatccacaatccataaaaaataactattacttaggcaaatttggaagagctgttcgtcatcataccatcgtaccaacaggtccaaatatggtaaaatgggaaaaataa

SEQ ID NO: 100 - DNA, 2073 bp, Streptococcus agalactiae
atgaaaaagaaaattattttgaaaagtagtgtccttggtttagtcgctgggacttctattatgttctcaagcgcattcgctgaccaagtcggcgtccaagttataggcgtcaatgactttcatggtgcacttgacaatactggaacagcaaatatgcctgacggaaaagttactaatgctggcactgctgctcaattagatgcttatatagatgatgctcaaaaagatttcaaacaaactaaccctaatggtgaaagcattagagttcaagctggtgatatggttggagcaagtccagctaactcagggcttcttcaagatgaaccaaccgttaaaacatttaatgcaatgaatgttgagtatggcacattaggtaaccatgaatttgatgaaggtttggcagaatacaatcgtatcgttactggaaaggcccctgctccagattctaatataaataatattacgaaatcatacccacacgaagctgcaaaacaagaaattgtagtggcaaacgttattgataaagttaacaaacaaatcccttacaattggaaaccttacgctattaaaaatattcctgtaaataacaaaagtgtgaacgttggctttatcggaatcgttaccaaagacatcccaaaccttgtcttacgtaaaaattatgaacaatatgaatttttagatgaagctgaaacaatcgttaaatacgccaaagaattacaagctaaaaatgtcaaggctattgtagtccttgctcatgtacctgcaacaagcaaggatgatattgctgaaggtgaagcagcagaaatgatgaaaaaagtcaatcaactcttccctgaaaatagcgtagatattgtctttgctggacacaatcatcaatatacaaatggtcttgttggtaaaactcgcattgtacaagcgctctctcaaggaaaagcctatgctgacgtacgtggtgtcctagatactgatacacaagatttcattgaaaccccttcagctaaagtagttgcagttgctcctggtaaaaaaacaggtagtgccgatattcaagccattgttgaccaagctaatactatcgttaaacaagtaacagaagctaaaattggtactgccgaggtaagtggcatgattacgcgttctgttgatcaagataatgttagtccagtaggcagcctcatcacagaggctcaactagcaattgctcgaaaaagctggccagatatcgattttgccatgacaaataatggtggcattcgtgctgacttactcatcaaaccagatggaacaatcacctggggagctgcacaagcagttcaaccttttggtaatatcttacaagtcgtcgaaattactggtagagatctttataaagcactcaacgaacaatacgaccaaaaacaaaatttcttccttcaaatagctggtctgcgatacacttacacagataataaagagggcggagaagaaacaccatttaaagttgtaaaagcttataaatcaaatggtgaagaaatcaatcctgatgcaaaatacaaattagttatcaatgactttttattcggtggtggtgatggctttgcaagcttcagaaatgccaaacttctaggagccattaatcccgatacagaggtatttatggcctatatcactgatttagaaaaagctggtaaaaaagtgagcgttccaaataataaacctaaaatctatgtcactatgaagatggttaatgaaactattacacaaaatgatggtacacatagcattattaagaaactttatttagatcgacaaggaaatattgtagcacaagagattgtatcagacactttaaaccaaacaaaatcaaaatctacaaaaatcaaccctgtaactacaattcacaaaaaacaattacaccaatttacagctattaaccctatgagaaattatggcaaaccatcaaactccactactgtaaaatcaaaacaattaccaaaaacaaactctgaatatggacaatcattccttatgtctgtctttggtgttggacttataggaattgctttaaatacaaagaaaaaacatatgaaataa

SEQ ID NO: 101 - DNA, 1740 bp, Streptococcus agalactiae
atggcatatatttggtcttatttgaaaaggtaccccaattggttatggcttgatttactaggagctatgctttttgtgacggttatcctaggaatgcccacagccttagcgggtatgattgataatggcgttacaaaaggtgatcggactggagtttatctgtggacgttcatcatgtttatatttgttgtactaggtattattgggcgtattacgatggcttacgcatctagtcgcttaacgacaacaatgattagagatatgcgtaatgatatgtatgctaagcttcaagaatactcccatcatgaatatgaacagataggtgtatcttcactagtgacacgtatgacaagcgatacttttgttttgatgcaatttgctgaaatgtctttacgtttaggcctagtaactcctatggtaatgatttttagcgtggttatgatactaattacgagtccatctttggcttggcttgtagcggttgcgatgcctcttttggtaggagtcgttttatatgtagctataaaaacaaaacctttatctgaaagacaacagactatgcttgataaaatcaatcaatatgttcgtgaaaatttaacagggttacgcgttgttagagcctttgcaagagagaattttcaatcacaaaaatttcaagtcgctaaccaacgttacacagatacttcaactggtctttttaaattaacagggctaacagaaccacttttcgttcaaattattattgcaatgattgtggctatcgtttggtttgctttggatcccttacaaagaggtgctattaaaataggggatttagttgcttttatcgaatatagcttccatgctctcttttcatttttgctatttgccaatctttttactatgtatcctcgtatggtggtatcaagccatcgtattagagaggtgatggatatgccaatctctatcaatcctaatgccgaaggtgttacggatacgaaacttaaagggcatttagaatttgataatgtaacattcgcttatccaggagaaacagagagtcccgttttgcatgatatttcttttaaagctaagcctggagaaacaattgcttttattggttcaacaggttcaggaaaatcttctcttgttaatttgattccacgtttttatgatgtgacacttggaaaaatcttagtagatggagttgatgtaagagattataaccttaaatcacttcgccaaaagattggatttatcccccaaaaagctcttttatttacagggacaataggagagaatttaaaatatggaaaagctgatgctactattgatgatcttagacaagcggttgatatttctcaagctaaagagtttattgagagtcaccaagaagcctttgaaacgcatttagctgaaggtgggagcaatctttctgggggtcaaaaacaacggttatctattgctagggctgttgttaaagatccagatttatatatttttgatgattcattttctgctctcgattataagacagacgctactttaagagcgcgtctaaaagaagtaaccggtgattctacagttttgatagttgctcaaagggtgggtacgattatggatgctgatcagattattgtccttgatgaaggcgaaattgtcggtcgtggtacccacgctcaattaatagaaaataatgctatttatcgtgaaatcgctgagtcacaactgaagaaccaaaacttatcagaaggagagtga

SEQ ID NO: 102 - DNA, 1632 bp, Streptococcus agalactiae
atgaaaaaaggacaagtaaatgatactaagcaatcttactctctacgtaaatataaatttggtttagcatcagtaattttagggccattcataatggtcacaagtcctgtttttgcggatcaaactacatcggttcaagttaataatcagacaggcactagtgtggatgctaataattcttccaatgagacaagtgcgtcaagtgtgattacttccaataatgatagtgttcaagcgtctgataaagttgtaaatagtcaaaatacggcaacaaaggacattactactcctttagtagagacaaagccaatggtggaaaaaacattacctgaacaagggaattatgtttatagcaaagaaaccgaggtgaaaaatacaccttcaaaatcagccccagtagctttctatgcaaagaaaggtgataaagttttctatgaccaagtatttaataaagataatgtgaaatggatttcatataagtctttttgtggcgtacgtcgatacgcagctattgagtcactagatccatcaggaggttcagagactaaagcacctactcctgtaacaaattcaggaagcaataatcaagagaaaatagcaacgcaaggaaattatacattttcacataaagtagaagtaaaaaatgaagctaaggtagcgagtccaactcaatttacattggacaaaggagacagaattttttacgaccaaatactaactattgaaggaaatcagtggttatcttataaatcattcaatggtgttcgtcgttttgttttgctaggtaaagcatcttcagtagaaaaaactgaagataaagaaaaagtgtctcctcaaccacaagcccgtattactaaaactggtagactgactatttctaacgaaacaactacaggttttgatattttaattacgaatattaaagatgataacggtatcgctgctgttaaggtaccggtttggactgaacaaggagggcaagatgatattaaatggtatacagctgtaactactggggatggcaactacaaagtagctgtatcatttgctgaccataagaatgagaagggtctttataatattcatttatactaccaagaagctagtgggacacttgtaggtgtaacaggaactaaagtgacagtagctggaactaattcttctcaagaacctattgaaaatggtttagcaaagactggtgtttataatattatcggaagtactgaagtaaaaaatgaagctaaaatatcaagtcagacccaatttactttagaaaaaggtgacaaaataaattatgatcaagtattgacagcagatggttaccagtggatttcttacaaatcttatagtggtgttcgtcgctatattcctgtgaaaaagctaactacaagtagtgaaaaagcgaaagatgaggcgactaaaccgactagttatcccaacttacctaaaacaggtacctatacatttactaaaactgtagatgtgaagagtcaacctaaagtatcaagtccagtggaatttaattttcaaaagggtgaaaaaatacattatgatcaagtgttagtagtagatggtcatcagtggatttcatacaagagttattccggtattcgtcgctatattgaaatttaa

SEQ ID NO: 103 - DNA, 1248 bp, Streptococcus agalactiae
atggaaaattggaagtttgccctatcatcgattctagggcacaagatgcgtgcttttctgaccatgttagggatcatcattggggttgcatcagttgtgttaattatggccttaggtaagggcatgaaagattcggttacaaatgagattacaaagtctcagaagaaccttcagatttattataaaacaaaagaagaccaaaaaaatgaggataactttggagctcaaggggctttcatgcaaggtagtgataccaaccgtaaggaaccaattattcaagaatcatggttaaaaaagattgctaaggaagtagatggtgttagtggctactatgtaaccaatcaaacaaatgctccagtagcttaccttgaaaaaaaggcaaagacggttaatataacaggagttaaccgcacttaccttggtatcaaaaagttcaaaattaaaagtggtcgtcaattccaagaggaggattataaccaattctcgagagttattttactagaagaaaaattagctcagagattattccagacaaatgaagcagcgttaaataaggtggtgactgtaaaaaataaatcttacttagtagtgggggtttattcggatccagaagctggttcaggcttatatggaagtaattctgatgggaatgctattttaaccaatacacagttagcttcggagtttggtgctaaagaagcagaaaacatatattttcatcttaatgatgtatcgcaatccaatcgcattggtaaagaaataggcaaacgtttaacagacattagtcatgctaaggatgggtactatgataattttgacatgacatctatagttaaatctatcaatacccaagttggtattatgacaggtgttattggagcgattgcagcaatttctctcctagttggtggtatcggagtgatgaatattatgttagtctctgtaactgagcgcacgagagaaattggccttcgtaaagcccttggggcaactcgacgtaaaattttagctcaatttttaattgaatcaatggtcttaacgattttgggtggattaattgggttattactagcctatggaggtacgatgttaattgctaatgcgcaagataagattactccttctgtgtcacttaacgtggctataggcagtttaattttctcagcatttattggaattatatttggtttattacctgctaataaagccagcaaattaaacccaattgatgctttacgatatgaataa

SEQ ID NO: 104 - DNA, 1215 bp, Streptococcus agalactiae
atgcagtattcagaaattatgattcgttatggagaactctctactaagaagaaaaaccgtatgcgcttcatcaataagttaaaaaataatatggagcatgtactctccatttatccagatgtttcagtaaaaacagatcgtgatagaggacatgtatatctcaatggtacagattatcatgaagttgcagagtccttaaaagagatttttggtatccaagctttttctccatcttttaaagtagaaaaaaatgttgatacattggtaaaagctgtccaggaaattatgacttccgtttataaagatgggatgacttttaaaattaccgcaaaacgtagtgaccactcatttgaattggatagccgtgctctaaatcatactttaggagatgccgttttttcagtcttgccaaatattaaggctcagatgaagcaaccagatatcaatcttaaagtcgagatacgagatgaggctgcttatatttcatatgagaatattaggggtgcaggaggattaccggtaggaacatctggaaaagggatgctgatgttgtctggtgggattgattctccggtggcaggttacctagcgttaaaacgtggtgtagatatagaagcagttcattttgcaagtcctccttatactagcccaggtgcattgaaaaaagcacatgatttaacacgtaaattgacaaaatttggtggtaatattcaatttattgaagttccattcacagaaattcaagaggaaattaaggaaaaagctcctgaagcctacttgatgacgttaacacgtaggtttatgatgcgtattacagatcgtattcgtgagaaccgaaatggtcttgttattattaacggtgaaagtttagggcaggtggcaagccaaacgctagaaagtatgcaagccattaatgctgtcactgcaacaccgattattcgtcctgtggtcacgatggataagctagaaattattgatattgctcaaaaaatagatacttttgatatttcaattcaaccatttgaggattgctgtacgatttttgcaccagatcgcccaaaaactaaccctaaaattaagaatacagaacagtatgagaaacgtatggatgtagaaggtctggtagagagggcagttgcagggattatggtaactactattcaacctcaagcagatagtgatgatgttgatgacttgattgacgatttattataa

SEQ ID NO: 105 - DNA, 360 bp, Streptococcus agalactiae
atggctcgtgttaaaggtggagttgtttcacgtaaacgtcgtaaacgcgtacttaaattagctaaaggttactatggtgcaaaacatatcttgttccgtactgcaaaagaacaagtaatgaattcttactactatgcataccgtgaccgtcgtcagaaaaaacgtgacttccgtaaattatggatcactcgtatcaatgcggctgctcgtatgaatggtttatcatattcgcaattgatgcacggtttgaaattagctgaaatcgaagttaaccgtaaaatgcttgctgatttagcagttaacgatgcagcagctttcacagctcttgcagatgcagctaaagctaaacttggtaaataa

SEQ ID NO: 106 - DNA, 1026 bp, Streptococcus agalactiae
atgtttaaagcttcaaaaaaactcgttcaaaaaaataagtcaaatcatttttggcttgtttttttcataacacttatactatttcttattggttgttacgccagcttacgatttggtgctatcaatttcaagactagtgatttaataactgttttaaaaaatcccttaaaaaactctaatgctcaggatgttatttttgacattagactaccacgcataattgcagctatcttagtaggtgcagctatgtcacaagcaggtgctattatgcagggagtcactcgaaacgccattgctgatcctggactactaggtattaacgccggagctgggttagcccttgttgttgcatatgcttttttagggagcatgcactatagtacgattctcattgtctgcttactagggtctgtcatttcttatcttttagtcttcacactctcttatacaaagcaaaagggttaccaccaactacgactcattttagctggagcgatgatctccacactttttacgtctgttggacaagtggttacattatactttaaactcaatcgaactgttatcggttggcaagcaggtggtttatcccaaattaactggaaaatgctaatcataatagcacctatcattattttaggtttacttatttcacaactcctagcacatcaattaactatcttgagccttaatgaatctgtggccaaagcattgggacaaaaaactcaattaatgactgcgtttctattacttattgttttgtttttatcggcttcatcagtcgcgttgataggaaccgtttctttcattggattgattattccacattttattaagctttttattcccaaagattatcgtctgttattacctttaataggattttcaggggctactttcatgatctgggtagacttatcatctcgtattataaatcccccttcagagacaccaattagttctataatcagtatcgtagggcttccatgtttcctatggttaattagaaaagggaaaaatctatga

SEQ ID NO: 107 - DNA, 567 bp, Streptococcus agalactiae
atgattaaaagaccaattcatctttctcatgattttttagcagaagttattgataaagaagcaataacgcttgatgcaactatgggaaatgggaatgatactgtttttttagcgaaaagttctaaaaaagtttatgcatttgatattcaagaagaagcaatagcaaaaacgaaagcaaagctcacggagcaagggatttctaacgctgaacttatcttggatgggcatgaaaatttggaacagtatgttcatacacctttaagagcggctatatttaatctgggatacttaccctcagcggataaaacagttattacaaaacctcacacaactatcaaggcaatcaaaaacgttttagacattttagaagtaggtggacgtctatcacttatggtttattatggtcatgatggtggaaaaagtgagaaagatgcggtgatagcattcgtggaacaattaccacagaataatttcgctacaatgctttatcaaccactcaatcaagttaatacgcccccctttttaattatggtagaaaagttacaatcatatgaaaatgaggtgtaa

SEQ ID NO: 108 - DNA, 1008 bp, Streptococcus agalactiae
atgcgagtacatattacaagtatatatgggcagtcaccgcgtagcattgcccttatatcacaaaaactagttaaggatgtcggacgtcaacttggttatgatgaaatgggaatctacttttataatgatcatgctgaaacgcatggtgaaagaagtactaggatggatggtatcattgcgggattaggcagaggggatattgttgtttttcaagtacctacatggaattcaacagaatttgatgaactttttctagataaattacaggcatacggtgctagaattataacttttgtacatgatattgttcccttaatgtttgagtctaatttttatttattagatagagtaattgacatgtataatcgttcggatgttgttattctacctacaaaagcgatgcatgattatctaattgaaaaagggatgactacctctaaagttctttatcaagaagtatgggatcatccagttaatatagacctccctcgtccagaatgtcaaaaagtccttagttttgcaggcgatattcaacgctttccctttgtcaatgactggaaggaaaatatcccgctcatctattatggagacggaagcagactcaattctgaggcaaatgttcatgctcagggatggaaagatgatgtagaattgatgctaagtctttctaagcggggaggatttggcctgtgttggagtgaagatagagaggagttagtcgagcgtcgttattcgaggatgaatgcctcgtataaattatctactttcttggctgctggacttccaattattgctaaccatgatatttcaagtagagactttatcaaacaacacggattaggatttacagttgaaacgctagaagaagctgttgaaaaaattaataatatggaaaaagagacttatgacagctatgtggaaaatgttgagaagatagcaactctcttgcgaaatggttatatcactaaaaaattgttgatagatgctgtgcatatgctttatagatag

SEQ ID NO: 109 - DNA, 3933 bp, Streptococcus agalactiae
atgtcccaaaagacttttggcaagcagttaacagttgtagatactaagagtagagtcaagatgcataaatcaggaaaaaactgggtaagaacagtaatgtcgcattttaatctatttaaagcgattaaagggagagcaactgttgaagcagatgtgtgtattcaagatgttgaaaaagaagaccgactatcttcaggaaatttgacctatctcaaaggaatactagctgccggagctctggtaggtggagcgagtttaaccagtcgtgtttatgcagatgagactccagttgttcaagaacaatcaagttctgtaccaacactggcagaacaaacggaagtgactgttaaaacaactactgttcaaaatcatcaagatgggacagtatcgaaaaacattattgattctaatagtgtatctatgtcagagtcagcctcaacaagtactagtgaatctgtaagtatgtctatgtcagggtcaactttaacaagtgtaagtgaatctgtaagtacatctgctttaacaagtgcttcagaatcgataagcacgtcagcctcagaaagtgtttcaaaatctacaagtattagtgaggtttcaaatattcttgaaactcaagcttctttaactgataaaggaagagagtcgttttcggcaaaccagatagtaacagaaagtagcttagttactgatgctggtaaaaatgcttcagtatctagcctaattgaaattacaaaaccaaaatcggagttacagacttccaaaatgtcaaatgagtcgcttataactccagagaaatcccaagtaatgattgcaagcgataaaactgggaatgagagtctaactccgacaattagattaaaatcagttattcagccaaggagtatgaacttgatgactttgagttcggagatggacttgataccactagaagaagtgtctgatactgaaatgttaggtaaagatgtatcaagcgagttgcagaaagttaatattgcgttaaaagataacactcttagtgagcctggaacagttaaattagatagttcagaaaaccttgttttgaactttgccttttcaatcgcttctgttaacgagggagatgtctttactgtaaagctttctgataaccttgacacacaagggattggtactattctaaaagttcaagatataatggatgaaacggggcagttattagcgactgggtcatatagtcctttaacacataatattacatacacctggacaaggtatgcttctacgttgaataatattaaagctagagtcaatatgccagtttggcctgaccagagaataatttctaaaacaacttcagataagcagtgctttactgcaacattgaacaatcaagttgcttcaattgaggaacgtgttcagtataatagtccttcagtgacagaacatactaatgttaagacaaatgtaagatctcggatcatgaagcttgatgatgaaagacagacagaaacttatattactcaaattaatcctgaaggtaaggaaatgtatttcgcatcaggacttgggaatctatatactattatcggttcagatggaacatcaggttcaccagttaatttattaaatgcggaagtaaagattctaaaaactaattcaaaaaatcttacagatagtatggatcaaaattatgattcgcctgagtttgaagatgtgacttcccagtatagttatactaacgatggttctaaaattaccatagattggaaaacaaattctatttcttccactacatcttatgttgttttggtcaaaatacctaaacaaagtggtgtattgtattcaactgtttctgatataaatcaaacatatggttctaaatattcttatgggcatacgaatataagtggtgactcagatgcgaatgccgaaattaaacttttatcagaaagtgcttctacgagtgcgtcgacgtcagcaagtaccagcgcttccatgagtgcctcgacatcagcaagtaccagcgcttccatgagtgcctcgacatcagcaagtaccagcgcttccatgagtgcgtcgacgtcagccagcaccagcgcttcaaccagcacctcaacgagtgcctcgacatcagccagcacaagtgcttcaacaagtgcaagtatgagtgcttcaacaagtgcaagtacgagtgcatccacgtcagcaagtactagcgcttccacaagtgccagcaccagcgcctcaacgagtgcctcaacgtcagccagcactagcgcctcaacgtcagccagcaccagcgcctcaaccagtgcttcaaccagtgcttccacatcagccagcactagcgcctcaatgagtgcgtcgatgtcagccagcacaagtgcttcaatgagtgcctcgacgtcagccagcactagcgcctcaaccagtgcttcaaccagtgcttcaaccagtgcttccacctcagcaagtatgagcgcctcaacaagtgcaagtactagcgcttcaacaagtgcaagtatgagcgcctcaaccagtgcaagtactagtgcttcaacaagtgccagtaccagtgcctcgacgtcaacaagtactagcgcttccacgtcagcaagtaccagtgcatccacatcagcaagtatgagcgcatccacgtcagccagcaccagcccctcaaccagtgcttcaaccagtgcttcaaccagtgcttcaaccagtgcttccacatcagccagcactagcgcctcaatgagtgcatccacgtcagcaagtactagcgcctcaatgtcagccagtactagcgcctcaaccagtgccagtaccagtgcttccacctcagcaagtatgagcgcctcaacaagtgcaagtactagcgcttccacaagtgcaagtatgagcgcctcaaccagtgcaagtactagtgcttcaaccagtgccagtaccagtgcctcgacgtcaacaagtactagcgcttccacgtcagcaagtaccagtgcatccacatcagcaagtatgagcgcatccacgtcagcaagtaccagtgcatccacgtcagcaagtatgagcgcctccacaagtgcaagtatcagtgcatccacgtcagcaagtatgagcgcttccacaagtgcaagtaccagtgcatcgacgtcagccagtactagcgcctcaatgagtgcatcgacgtcagccagcaccagtgcttccacaagtgcaagtactagcgcctcaatgagtgcatcgacatcagcaagtaccagcgcttccacaagtgcaagtacgagtgcttccacatcagcaagtactagcgcctcaacatcggcaagtacaagttcttccacaagtgcaagtaccagtgcatcgacatcagccagcactagcgcctcaatgagtgcctcgacgtcagccagcacaagtgcttccatgagtgcgtcgacgtcagccagcactagcgcctcaacgagtgcgtcaatgtcagccagcacaagttcttcaacaagtgcctcgatgtcagccagcactagcgcttcaatgagtgcctcgacgtcagctagcactagcgcctcaacgagtgcgtcaatgtcagccagcacaagttcttcaacaagtgcctcgatgtcagccagcactagcgcttcaatgagtgcgtcgacgtcagccagcaccagcgcttcaacgagtgcgtcaatgtcagccagcactagcgcttcaatgagtgccacgacgtcagccagcaccagcgtctcaacgagtgcatcgacatcagcaagtaccagcgcttccacaagttcttcaagctcagtgacttctaattcatcaaaagagaaggtgtattctgccttaccttctacgggtgaccaagattattctgtaactgctactgccttaggtttaggtttaatgactggtgcaacccttttgggacgaaaaaaatctaaaaaagataaagactaa

SEQ ID NO: 110 - DNA, 1992 bp, Streptococcus agalactiae
atgatagatagaaaagatactaaccgatttaaattagtttccaaatatagcccttcgggagatcaacctcaagctattgaaacgttggttgacaatattgaaggaggagaaaaagctcagattttaaaaggtgctactggtactggtaaaacctacacaatgagccaagttatcgcccaagttaacaagccaaccttggtgattgcacataataaaaccttagcaggtcaactttatggagagtttaaagaattttttcctgacaatgccgtagagtactttgtttcatattatgattattatcaaccagaagcttatgtgccttcttcggatacttatattgaaaaagatagttcagtcaatgacgaaattgacaaattacgtcactcagcgacttcttcgttattagaaagaaatgacgttattgttgtagcatctgtttcttgtatttacggtttaggttctcctaaagagtatgcagacagtgttgttagccttaggccaggtcaagaaatttcacgtgatcagttattgaacaatctcgttgatattcaatttgagcgtaacgatattgattttcaacgtggaaaatttcgcgttcgtggcgatgttgtagaagtttttcctgcgagtcgtgatgagcatgcctttcgaattgaattttttggtgatgaaattgatcgtataagagaaatagaatcgttaacagggcgtgtgctaggagaagtggaacatttagctattttcccagcaacacactttatgacaaatgatgaacatatggaagaagctatttcaaaaatacaagctgaaatggaaaatcaagtagaactttttgaaaaagaagggaaattgattgaagcgcaacgtattcgacaaaggacagaatatgatattgaaatgcttcgtgaaatgggatatacaaatggtgttgagaactactcacgtcacatggatggtagaagtgaaggtgagccaccttttactttgttagatttcttcccagaagattttttgattatgattgatgagagtcacatgacaatggggcaaatcaaagggatgtataatggagaccgttcgcgtaaagaaatgttggttaattacggtttccgtttaccatctgccttagataaccgtccacttcgtcgtgaagaattcgaaagccatgtccatcaaattgtctatgtatctgcaacgccaggagactatgaaatggagcaaacagatacagttgttgagcaaattatccggccaacaggacttcttgatccagaagttgaagttagaccaagtatggggcagatggatgacttgcttggtgaaatcaatttgaggactgaaaaaggtgagcgtacctttattacaacattgacaaagcgtatggcagaagacttaacagattatctcaaagaaatgggagttaaagttaagtatatgcacagcgatattaaaaccttagaacgtacagagattattcgtgatttacgacttggtgtgtttgatgttttaattggtattaatctcttacgtgaaggaatagatgttcctgaggtttcccttgttgcaatcttagatgctgataaggaaggtttccttcgtaatgagcgtggtcttatccaaacaatcggacgtgcagcacgtaacagtaatggtcatgttattatgtatgctgataaaataacagattctatgcaaagagctatggatgaaaccgctcgccgtcgtcgtttacaaatggattataatgaaaagcatggaattgtgccacaaacaattaaaaaagaaatccgtgatttaattgctattactaaaagtaatgacagcgataagcctgaaaaagttgtcgattacagtagtttatctaaaaaagaaaggcaagctgaaattaaagctcttcaacagcaaatgcaagaagcagctgaattattggactttgagctagctgcacaaatccgagatgttatcttagaactaaaagcaatcgattaa

SEQ ID NO: 111 - DNA, 2184 bp, Streptococcus agalactiae
atgaagcacaagttaaaagcttttacgcttgctttactctcaatattctttgtgtttggtggaaaggtcagtgcagaaactgtgaatattgtttctgatacagcatacgctccattcgaatttaaagattctgatcaaacttataaaggaatcgatgttgacatcgttaacgaagtcgctaagcgtgctggctggaatgttaacatgacgtacccaggttttgatgccgcagttaacgctgttcaatctggacaggcagacgcgctaatggccggaactactgttactgaagcacgtaaaaaagtctttaatttctcagatacttattacgatacttccgttattctttatactaaaaataataataaagtcacaaactacaaacaactaaaaggaaaagtagtcggtgtaaaaaatggaacagctgctcaaagcttcttagaggaaaataaatctaaatacggctataaagttaaaacatttgatacaagtgacctaatgaataacagccttgattctggttctatttacgccgctatggacgatcaaccagttgtgcaatttgcgataaatcaaggaaaagcttacgccattaacatggaaggcgaggcagttggtagctttgcatttgctgtcaaaaaaggtagtggacacgataacctaattaaagaatttaacacagcttttgcacaaatgaaatcagatggcacttataatgacatcatggataaatggcttgggaaagacgctacaaaaacaagcggcaaagcaacaggtaatgccaatgaaaaagcaactcctgtaaagccaagttataaaattgtttctgattcttcattcgcaccattcgaatatcaaaacggtaaagggaaatatactggttttgatatggaattaatcaagaaaattgctaaacagcaaggttttaaacttgatatctcaaatccaggttttgatgccgctttaaatgctgtccaatctggacaagctgacggtgttattgcaggagctacaatcacagaagcacgccaaaaaatctttgatttttctgatccttattacacatctagcgttatcttagcggttaaaaaaggaagcaatgtcaaatcataccaagatttaaaaggaaaaacagttggtgctaaaaatggtactgcctcatatacttggttatcagaccacgcagataagtacaactatcatgttaaagcatttgatgaagcatctacaatgtatgatagtatgaactcaggttcaattgatgctctaatggatgacgaagcagttcttgcttacgctattaatcaaggtcgtaaatttgaaacacctatcaaaggtgaaaaatcaggcgatatcggatttgcagtgaaaaaaggggcaaatccagaattaattaaaatgtttaacaacggtcttgcttcactcaaaaaatcgggtgagtacgataaacttgttaaaaaatacctttccacagccagcacctcttcaaacgataaagctgctaaacctgtagatgaatcaactattttagggttaatttctaataactacaaacaattgctatctggtattggaactactttaagtttaactcttatctcatttgcgattgctatggttattggtattatctttggtatgatgagcgtatcaccaagtaatactctccgcacaatttcaatgatttttgttgatattgtccgtggtattccactcatgattgtggccgcttttattttctggggtattcctaatttaatcgaaagcatcacaggtcaccaaagtccaattaatgacttcgttgctgctactatcgctctttctttaaatggtggtgcgtacattgctgaaattgtacgtggtggtattgaagctgttccttctggtcaaatggaagcaagtcgtagtttaggtatttcttacggcaaaactatgcaaaaggttatcttgcctcaagcagtacgccttatgttaccaaactttatcaaccaatttgtcatctcattaaaggatacaacaattgtatcagcaatcggacttgtggaactcttccaaactggtaaaatcataattgcacgtaactatcaatcattccgtatgtatgctatccttgcaattatgtatcttgtaatcattacccttctcacccgtctagcaaaacgtttagaaaagaggcttaaataa

SEQ ID NO: 112 - DNA, 159 bp, Streptococcus agalactiae
atgggagataaaccgatatcatttcgtgataaagatgggaattttgtttcagcggccgatgtctggaatgctgaaaaattagaagaactctttaacacattaaatcctaatcgtaaacttcgtttagaacgcgaaaaattagcaaaagaaaaaggatag

SEQ ID NO: 113 - DNA, 843 bp, Streptococcus agalactiae
atggaaacatatactctatcgaatactcttaacattcctaaaattggttttgggacatggcaactaactgaaggtgaagaagcttataaggcagtgactcatgctttaaaagttggttatactcatattgatactgctcagatttatggcaacgaacacagtgttggacgtgctataagagacagtggtttggcgcgagaaagtatctttttgacaactaagatttggaatgacaaacatgactatcatttagccaaagcttctattgatgaatctctgcagaaattaggtgttgattatattgatcttcttttgattcattggccaaatccaaaagctcttcgtgaaaatgatgcgtggaaagctgggaatgcaggcacttggaaagcgatggaagaagcttataaagaaggaaaggtaaaagctattggtgtttcgaatttcatgaaacatcacttagaggctttatttgaaactgccgaaataaaacctatggttaatcaaattatcctagcaccaggttgtgctcaagaggatttggttcgcttctgtaaaggaaatgatatcttattagaagcttacagtccatttggaacaggtgctatttttgaaaatgaatctataaaagctattgctgaaaaatatggtaaatcagttgcacaagtagctcttcgctggtcacttgataatggctttttaccattacctaagtcagcgactcccaaaaatattgaagcaaaccttgatatttttgattttcaattaaacgaagatgatattactaccttaatacaactagattcaggtattaaacccaaagatccagataatgtctcattttaa

SEQ ID NO: 114 - DNA, 468 bp, Streptococcus agalactiae
atggttaaaggtcaaggaaacgttgtagcacaaaataaaaaagcgcatcacgactatactatcgttgaaacaatagaagcaggaattgttttgacaggaacagaaatcaaaagtgtccgcgcagcgcgtattacattgaaagatggatatgcacaaataaaaaatggtgaagcgtggttgattaatgttcatattacaccatacgatcaaggtaatatatggaatcaagatcctgatcgtacacgaaagttattactaaaaaaacgtgagattgaaaaaatatcaaatgaactgaaagggactggtatgactctggtacctctaaaagtttacttaaaagatggttttgctaaagttctattgggtttggcaaaaggaaaacatgattatgataagcgagagtctatcaaacgtcgtgagcaaaaccgtgatattgcccgtcagttaaaaaactataattcacgatga

SEQ ID NO: 115 - DNA, 804 bp, Streptococcus agalactiae
atggaccatttcacaaaactctggcaagatttctctaaacttccaaatgttgttgctatagcactcggaggctcacgctctggtgacagttttgaccaatcttccgattatgatttgtatgtttattgtgcagcaactcctgatatcactagtcgtaaacgtatccttaacaagcactgtcattacattgaacttaacaatcattactgggagcttgaagataatggtactttaaacgacggaactgatattgatattctctatcgtaacatagataactttttatcagacttagaagatgtcgttgaacaccacaattctcgaattggatacactacttgtttttggcataacctcatcaattgccaaatactctatgatcctgaaaatcaattacaatcactcaaagagagattcgaagtttcttatcccagtcagttacaaaaacaaattatcattcaaaatcgtaacttattaactggcaagcttccctcttacgataaacaaattataaaagcccttaaacgccaagactttgttagtactcaccatagaactactgctttcttagattcctactttgatattatttttgcacttaataagttgacacatcctggcgaaaaaagaatgatttcctatgctaagaagaatgctacattgcttcctaaacatttcgaagaaaatatcattaaactatgtcatcacaactccaacgaacacactgttaaagaaacattaaacgatataataatgcatctcgacgtcatgcttaaagaaaattttcaacactttataggttaa

SEQ ID NO: 116 - DNA, 804 bp, Streptococcus agalactiae
atgaaaaaaattatttatcttggtttagcctgtgtcagtatattaactttaagtggttgcgagtcaattgagcgttctctaaaaggagaccgttatgttgaccaaaaactagctgaaaactcttcaaaggaagctactgaacaactaaacaaaaaaactaagcaagccttaaaagctgataaaaaagcttttcctcaattggacaaggctgttgccaaaaacgaggcacaagtgcttataaaaacctctaaaggtgatataaatatcaagttatttccaaaatatgctcctttagctgttgaaaattttctaacacatgcaaaagaaggatactataatgggttaagtttccacagagttatcaaagattttatgatacaatctggtgaccctaatggagacgggaccggtggaaaatctatatggaatagcaaagataaaaagaaagattctggaaatggttttgttaatgaaatatccccttacctctacaatatcaggggaagtttagcaatggcaaatgctggagctgatactaatggcagccaattctttatcaatcaaagccagcaagatcattccaaacaactgtcagataaaaaagttcctaaggtgattattaaagcctattcagagggaggaaatccaagtttagatggtggttataccgtctttggacaagtaatctctggcatggaaactgtggataaaattgcttcggtagaagttacaaaatcagatcaaccaaaagaaaaaattactattacaagtatcaaagttattaaagactacaaatttaaataa

SEQ ID NO: 117 - DNA, 690 bp, Streptococcus agalactiae
atgaaaattggaattattgcagccatggaggaagagttaaaactccttgtggaaaatcttgaggataaatctcaagagacagtattatcaaatgtatattacagtggacgttatggtgaacatgagcttgttttagtacagtctggtgttgggaaagtcatgtcagcgatgagtgttgctattttagtagaaagctttaaagttgatgctattattaatacaggatcagctggtgcagtagcaacaggattgaatgtaggagacgtcgttgtcgcagatacattagtttatcacgatgtagatttaaccgcctttggttatgactatggacaaatgtcaatgcagccactttattttcattcggataagacttttgtttccacttttgaagcagttttatctaaagaagaaatgactagtaaagttggtttaattgcaactggggatagttttattgctggccaggaaaagattgatgttattaaggggcattttccacaggttttagctgtcgagatggaaggtgcagcaattgcccaagctgctcaagctacaggaaagccctttgtggtggtacgtgctatgagtgatactgcagctcatgatgccaatatcacatttgatgaatttatcattgaagctggtaaacgctctgcccaagtattaatggcatttttgaaagcattataa

SEQ ID NO: 118 - DNA, 1167 bp, Streptococcus agalactiae
atggaaaagagacttagtttaggagctcttgttttagctagtacagttcttttagcagcatgtggaaatgtcggaggaggagcatcttcgacaggaacaaaaatagggaaagatattaaggtagggtataactgggaattatcaggaaacgtttcttcgtatggaaattcaatgaagaatggagctgacttagcagtaaaagaaattaatgctgctggaggggttggcggcaagaagttaaaagtcctatcacaggataataaatcagaaaatgcagaggcagcaacggttgccacaaacttggttaccaaaggagctaatgtcattatcggaccagcaacatcgggtgcagctgcatcttcaactccaaaagtaaatgcagcagcagttccaatgattgcacctgctgcgacacaagacaatttagtctatggttctgatggaaaaaccttaaatcagtatttcttccgagctacttttgtcgataattatcaaggaaagctattgtctcagtatgctacagacaaccttaaagctaaaaaagttgttctattttatgataattcatcagattactcaaagggggtagcaaaatcatttaaggaaagttatagtggaaaaattgttgatagcatgacattctccgctggtgatactgatttccaagcgtcattgactaagttgaaagggaaagaatatgatgctattgtgatgccaggttactataccgagacaggattaatagttaagcaagcgcgtgatttaggtatctctaaaccggttcttgggcctgatggttttgatagtccgaaatttgtgcaatcggcaacacctgtgggagcttcaaacgtttattatttgacaggtttcactacacaaggatcaaccaaagctaaagctttccatgatcattacgttaaggcatatggtgaagaaccatccatgttctcggctttatcatacgatgccgtgtatatggcagctaaatctgctaaaggagctaaaacttcaattgatcttaaaaaagctttagctaagctgaaagattttaaaggtgtgacagggaaaatgtctattgataaaaatcataatgttgttaaatcagcttacgttgtcaaattagacgatggaaaaacaagtagcgttaacattatttcagcaaaataa

SEQ ID NO: 119 - DNA, 1353 bp, Streptococcus agalactiae
atggagaatcataattctattaaacagacctatggattaatgactacaattgctatgattgtaggtgtagtgattggttcaggcatttattttaaagttgatgacatccttaaatttactggtggagatgtctttttaggcatggtaattttagtactaggttctttttcgattgtttttggaagtttgtcaatttctgagctagctattagaacgagtgaaagtggtggtattttttcttactacgaaaaatatgttagcccagctttagcagcaactttaggcttgtttgcgtcttttttgtatcttccaactttaacagcaatcgtttcatgggtagctgcattttatactttaggtgaatcatcaagtttggaatcacagattattttagctgctgtttatattttagcacttagtctcatgaatatctttgctaagcgtattgcagggggattccaatctttaacgacctttgtaaaaatgattcctttagtcctaattgctttaattggtgctttttggtctgataaagctccacaacttccacaacatttaacagctattcagccgtcaaatgttggatggagttgggtgtcaggtctggtaccattgtattttgcatatgatggttggacaatttttgttagtattgcaccagaagtcaagaatcccaagaagaatttaccacttgcctttgtcattggtccagcgcttatcttattatcatatttggcatttttctatggtttgacacaaattttaggtgctagctttattatgacaaccggtaatgatgctattaattatgcagctaacattattttcggtcctagtgttgggcgtttattatctttcattgttattttatctgtattaggtgttgccaatggacttttacttgggacgatgcgtctacctcaagcttttgcggaacgcggatggatcaaaagtgagaggatggctaacataaatttgaagtatcaaatgtcattgccagctagtttgacggtgacggctgtagctattttttggctttttgttcactttatggttacaaaatttaatttattgccgggtagtgatattagtgaaattgctgtggtgtttaataatactagtttaatcattctttatgttttagtactcagcctttatctcaaaaaagatattaaaaataaatttaccggcttagtttcaccgattctagcaattttaggcggtttgatcctctttatcgggagtttgttaagtaatttctttacggttttaattttccaatgtttttgcttattattctgtttgatttgtcattatatctatcaaaaaaataacccaaaaactcatgaatag

SEQ ID NO: 120 - DNA, 1803 bp, Streptococcus agalactiae
ttgaccgaatttaatgacgatcagcattctaaccatgatcagaaaagttttaaagaacaaattctggcagagttagaagaagctaaccgtttgagaaagttgcgtgaagaagaactctatcaaaaagagcaagaagccaaagaagctgctcgcagaacagcacaattgatggcagattatgaagcgcaacgtttgaaagacgaacaagaagctagagcaaaggcgctagagactaagcaacgcttagaagagcaagagaaggctcggattgaggcgaaacttctggcagaagctgctcgagaagaagaaagacgtcaggcggaacaagcattagcttcccaagaagaacaagttatcaatcaagggatggaaccttcaagagagcttgatagcggctccaaatctagtgaatttaggacaactgaaaatgtacctgacatagatttaaaagcagataagactgatgttgcaactgctgtgcctaatcaagaaacggaagaaatctttcttgtgagagcaacagatattcctacagaaggtgaaaatgtaaaacttggtgagacatcagagttagagcccgtagcaaaggaacctatccgagtagaggatttgtcaaaagaagaagaggatatagctttgtcagccaagaacaaacataacaagcgtgaaagacgtcagaaagcagataatgtggcaaaacgaattgcacgtattctgatatcaattatcatacttgtattgctcttgacagcatttgtaggttatcgttttgtagatagtgctattaaacctgttgattccaattcaaataaatttgtacaagttgaaattccgataggatctgggaataaattaattggtcaaattttagaaaaagcaggagtcattaagagcgccacagtctttaattactattccaagttcaaaaactatagtaattttcaaagtggatactacaatcttaaaaaaagtatgactttagatcagattgctgctgaattggaaaaaggcggaactgcagaaccgacaaaaccagctttaggtaagatattaattaccgagggttacactattaaacagattgctaaagctattgagtctaataaaattgatacaaagactacaagtacaccttataaagctgatgatttcttgaaacttgttcaagatgaaacgtttattaaaaaaatggtagctaaatatccaaatttactaggaagtctacctgataaatcaaaagctatttatcaattggaaggatatttattcccagctacttacaactattataaagatacaaccttagaaggacttgttgaagatatgatttcaacaatgaatactaagatggcaccttactataacactattaaagcgaagaatatgtctgtaaatgatgttttgacattatcatctcttgttgaaaaagagggatcaacagacgaagatcgccgtaaaatagcaagtgtcttttataaccgattatcagccggtcaagctcttcaaagtaacattgcaattttgtatgctatggggaaattaggtgataaaacaagtttagctgaagatgctcaaattaatacttcaattaaatcaccatacaacatctatactaatactggtttgatgcctggaccagttgatagtccaagtatctcagcaattgaagcgactataaaacctgcttcaacagattatctttattttgtcgctgatgtgaagaccggaaatgtatactacgctaaagactttgaaacacacaaggctaacgttgaaaaatatatcaatagtcaaattaactaa

SEQ ID NO: 121 - DNA, 3099 bp, Streptococcus agalactiae
atgagtagaatgattccaggacgtattcgaaatcaaggtatagaactctacgaacaaggtttggtgtccttgatttctcaagaaggtaatctattaaaagctaaagttggggattgtcagattgaatattcattagtaacagaagaaacaaaatgttcttgtgatttttttgcaagaaaaggctattgtcaacatttagctgctctggagcatttcttgaaaaacgacccagagggtaaagcaatcttatctaaagttcaagttcaacaagaaagtcaacaagaaactaagaagaaaacctcttttggtagtgtttttttagatagtctaattattaatgaagatgatactataaaatatcaactatcggctcaaggagaacaaaatccttatgctaatgatatctggtggactttaaaaattagacgactgcctgatgatagaagttatgttattcgtgacatcaaagcttttttaaatactgttcgaaaagaagcttattatcagattggaaaacaatactttgaaactttgtctttgatacagtttgatgagaccagtcaagaattgatagaatttttatggaggctcattccaagtcattcaagcaaaattgatctagagtttattttaccaaatcaaggtcgtcaccttagtctcactcgtggtttttttgaagagggcgttactttgatgaatgctttagaaaatttttcatttgaaagtgattttcatcaatttaatcacctctactttaaggaattagaaggtgaggatcatctttatcaatttaaggttattgtccataggcaatcaattgaattagaaatcaaagagaaagacttaaaaccactatttgcgaattcttatttgttttatcgcgatactttctaccatcttaatttgaagcaagaaaagatggtaacggctattcgtagtcttcccattgagggagatttagcaaaacatatccattttgatttagatgatcaagataagttagcagctcatttactggattttaaggagattggactagtagatgctccacggagcttctctattcatgattttaaggtaaattttgagttcgatattaatagtcaaaatgaaattttattgcaaatggtatttgattatggtaatgatttaactgttcataatcgtcaagaactagaacagttaacatttgctagtcacttcaaacatgaagaaaaaatatttaaactcttagaaagatatggctttgcaccccacttttcaaccagccatccagcatacagtgcacaagaattatacgatttttatacctatatgcttccacaatttaaaaaaatgggaacagtgagcttatccgcaaaattggaaagttatcgtctcatagaacgaccgcaaattgatattgaagctaagggaagcctgctagatatttcttttgatttctctgatttactggaaaacgatgttgatcaagctctggtagctttgtttgacaataatccttattttgtgaataaatcagggcaattagttatttttgatgaagagactaagaaagtaagtgcaactttgcaagggttgagagctagacgagcaaagaatgggcatattgaattagataatattgcagcatttcaattatcagaactgtttgcaaatcaagataatgttagcttttcacaacatttttaccaattgattgaagatttgagacacccagaaaagtttaaaatacctggtctatctgtttcagcttccttgcgcgattatcagcttacaggtgtccgttggttaagtatgttagatcattatggctttgcagggattttagctgatgatatggggcttggaaaaacacttcaaacgatttcatttttaagtacaaaactaactagagattctcgtgtgcttattttatcaccatcaagtttaatttataattggcaagatgaattccacaaatttgcgccagacgtagatgtagcagttgcctatggttctaagattcgtagagatgaaattattgctgaacgtcatcaagtaatcattacaagttattcatcatttaggcaggattttgagacttattctgaaggaaattatgattatttaattttggatgaagcacaggttatgaaaaatgctcaaactaaaatagcccatagcttgagatcttttgaggtcaaaaactgttttgcattatcgggaacacctattgagaataaactgttagaaatttggtccattttccagatcattttacctggtttattacctggtaagaaagagtttttgaagttgaaccctaaacaagttgctcgttatatcaaaccatttgtgatgagacgtcgaaaagaagaagttctcccagaattaccggatttgattgaaatgaactatccaaatgaaatgacagacagtcaaaaagttatctatttggcgcaattacgccaaattcaagaaagtatccaacattctagtgacgctgacttaaatcgtcgtaaaattgaaattttatctggcatcacacgattacgtcaaatttgcgacactccacgtctttttatggattatgatggtgaaagcggtaagttagaaagcctacatcaacttttaacacaaattaaggaaaatggacatcgtgctctgattttttctcagttcaggggtatgttagatatcgcagaacgtgagatggtagctatggggcttacaacttataaaattactggttctacaccagcaaatgaacgtcatgaaatgaccagagcatttaatgcaggatcaaaagatgctttcttgatttctttaaaagctggtggcgttggtctcaaccttacaggagctgataccgttgttctgattgacttgtggtggaatccagctgttgaaatgcaggcgattagtcgcgcacataggttggggcaaaaagagaatgtcgaggtttatcgcttgattactagaggcacaatcgaagaaaaaattctagaaatgcaagaaactaaaaaacatttggttacaacagttctggatggaaatgaaacccatgctagcatgagtgtagatgatattcgagagatacttggagtttctaaataa

SEQ ID NO: 122 - DNA, 534 bp, Streptococcus agalactiae
gtgttacttacagaaatcaaaaaatcaccagaggggctttattttgataaaaaaatagatatcaaagagtcgcttatggagcgtcattcagagataatggatatttctgatattcaagtttcaggtcatgtggtgtatgaagatggtctctatctacttgactataatatggcttacgatattacattaccgtctagtcgttctatgaaaccagttgttttatctgaaaagcaaactattaatgaagtttttattgaagctgaaaatgttagcactaaaaaagagctcgttgatcaggatttggtcttaatattagaggaagatgatattaatttagaagaaagcgttatcgataatatcttgttaaatatacctcttcgtgttctggcagctgatgaggttggggtagaagcggatttatcaggtaaaaattggtcgttaatgactgaaaagcagtatgaagaaaaacaagctaaagaaaaagaaaaatctaatcctttcgcagccttagaaggtatgtttgatagtgattag

SEQ ID NO: 123 - DNA, 579 bp, Streptococcus agalactiae
atggaagtaaaaactgcaatagaatggatgcacacttttaaccaaaaaattcaatccaacaaggactatttatccgaactagatactccaataggtgatggcgaccatggtggcaatatggcgcgtggtatgactgctgttattgaaaaccttgataacaatgaatttagtagtgctgccgatgttttcaaaaccgtatccatgcaacttttaagcaaagtaggcggagcatctggaccactctatggttctgcatttatgggaattacaaaagctgaacagagtgaaagtaccatttcagaggcacttggcgcaggacttgaaatgattcaaaaacgtggtaaagctgaacttaatgaaaaaacaatggttgatgtttggcacggtgttattgaagcgattgaaaaaaatgaattgactgaagaccgtattgattccttagtagatgctacaaaagggatgaaagcaacaaaaggacgcgcttcttatgttggagaacgctcattaggacacattgatccagggtcattttcttcaggattattatttaaagcattactagaagttggaggtgtctaa

SEQ ID NO: 124 - DNA, 2829 bp, Streptococcus agalactiae
atgcaagataaattaatgataagaggagcaagagctcacaatttaaaaaatataagtgtcgacatcccacgagacaagttagttgtcgttacgggactatcaggatcaggtaagtctagtttggcctttgacactatctatgcagaaggacaacgtcgttacgttgaaagtctttctgcttacgcgcgccaatttttgggaaatatggaaaagcctgatgtagattctattgatggccttagtccagctatttctattgatcagaaaacaacaagtaagaatcctcgctctactgttgggactgtaacagaaattaacgattatttacgtttgctttatgctcgtgttggaaccccatattgtatcaatggtcacggagccatcacagcatcttctgtagagcaaattgtggataaggtactagcgcttccagagcgaacaaagatgcaaattttagccccaattatacgtcgaaaaaaaggacaacacaaatcaacatttgagaaaatacaaaaagatggttacgttcgtgttcgtattgatggtgatattcacgatgttactgaggtgcctgaattatcaaaaagtaagatgcacaatattgatattgtagtagatcgattaattaataaagagggcattcgttcccgcttatttgattccgttgaagcggctctacgtttgtcggatggttatgtcgttattgatacaatggatggcaatgagttattgttttcagagcattattcttgtcctgaatgtggttttactgttcctgaattagagccacgccttttttcttttaatgctccctttggttcttgtacgacctgtgatggcttaggaattaagttagaagtggatatagatttggttattccagataaaagcaagacccttagagaaggggccttagttccttggaatccaatttcatcaaattattatccaacgatgctagagcaagctatgactcaatttgatgttgatatggatacgccatttgaaaaattaagcaaggcggagcaggacctagccctatatggttcaggcgaacgagagttccatttccattatattaacgattttggaggcgagagaaatattgatttgccttttgaaggggttgtcaataatattaatcgtcgttaccatgaaactaatagcgattacacacgcaatgttatgcgagaatatatgaacgagctaaaatgtaacacttgtcatggctatcgtctcaatgatcaagcactttgcgtaagagttgggggagaagaaggtcttaatattgggcaagtctcagatttatcgatagcagaccatttagaacttttagaaacgttgcgtttatcttcaaatgaacaattaattgctcgaccaattatcaaagaaattcatgaccgcctaagtttcttaaataatgttgggcttaattatttaaatctgtcacgttctgcaggaacgctttccgggggcgagagtcaacgtattcgtttggctactcaaattgggtctaatttatcaggtgtcctttatgtacttgatgaaccgtccattggacttcatcagcgagacaatgaccgtttgattgatagtcttaagaaaatgcgtgatttgggtaatacgcttattgttgttgaacatgatgaagatacaatgatggcagctgattggttaatcgatgtgggacctggcgctggtgcgtttggtggtgagattgtggcctctggcacaccgaagcaagtagctaaaaatactaaatctattacaggacaatatttgtcaggtaagaaagtgattcctgtgccatctgaacgaagagtaggcaatggtcgctttttagaaatcaaaggtgcggcagaaaacaacctacaaaatttagatgtcaagttccctctcggtaaatttattgccgtaactggtgtctcaggttctggaaaatcaaccttaattaatagtattttgaaaaaagctgttgcgcagaagcttaaccgtaactcagataaaccaggtaaatatgtttctttagaaggcattgaatatgttgatcgattgattgatattgaccaaagtccaattggtcggaccccacgttctaatcccgcaacctatacaggtgtttttgatgatattcgtgatctttttgctcaaactaatgaggcaaaaattcgaggttataaaaaaggacgcttctcatttaacgtcaaaggtggacgttgtgagtcttgttctggtgatggtatcatcaaaattgagatgcattttttaccagatgtctacgttccttgtgaagtatgccacggcacgcgctataatagtgagactctggaagtacattacaaagaaaaaaatattgcacaaattcttgatatgacagtgaatgatgcagttacattttttgcagctattcctaaaattgctcgtaagttacagactattaaggatgttggtttgggatatgtcactttggggcaaccagctacaaccttatcaggaggagaagctcagcgaatgaagttggcaagtgaattacataagcgttcgacaggtaagagtctttacatattagacgaaccaacaacggggcttcatgcagatgatattgctcgcttacttaaggttttggatcgttttgtagatgatggtaatacagtgcttgttattgagcataaccttgatgttattaaaactgctgaccacattattgatctcggccctgaaggaggtattggtggcggacaaattgtagctatcggaacaccagaagaagttgctgaaaatcctaaatcctatacaggatattatttaaaagagaagttagcaagatag

SEQ ID NO: 125 - DNA, 1125 bp, Streptococcus agalactiae
atgtggcctgaagatagaatcgcttcttttcgtcgcacacttttagggtggtatgaccaagaaaaacgtgatctcccttggcgaagaactactaatccatactatatttgggtttctgaaatcatgttgcaacaaacacaagttaatacagtaatcccttattataaacgttttctagagtggtttcctcaaataaaagatttggcagacgctcctgaagaacaattactaaaggcatgggagggactaggttattattctcgggtgcgtaatatgcaaaaggctgcacagcaagtgatggttgattttggtggcatatttcctcacacttatgatgatattgcttcattaaaagggattggtccttatactgcaggtgctatcgccagcatctcattcaacttaccagagcctgccgttgatggcaatgtgatgcgtgtcatggctcgtttgtttgaagttaattatgacatcggtgaccctaaaaatcgtaaaatttttcaagctattatggaaatactaattgaccctgacagacccggtgattttaaccaagcacttatggatctgggtacagacatcgaatccgctaagacacctagacctgatgaaagccctattcgtttctttaatgctgcttatttgaatggtacttatagtaaatatcccataaaaaatcctaagaaaaagcctaaaccaatgcgaattcaggcttttgtcattcgtaaccaaaatggccaatatctactggagaaaaatactaaagggagacttctagggggtttttggtcatttcctattatcgaaacgtcacctctttctcaacaattagatttatttgatgacaatcaatccaaccccataatctggcaaacccaaaatgaaactttccaaagagaatatcaattaaagccccaatggactgataatcactttcccaatattaagcacacttttagtcaccagaagtggacaatagaactcatagagggggtggtcaaagcaacagatttacctaatgctcctcacctaaagtgggcagcaattgaggacttttctctgtatccctttgcaacgccacaaaagaaaatgctggagacctacttaaaacagaaaaatgcttaa

SEQ ID NO: 126 - DNA, 849 bp, Streptococcus agalactiae
ttgatcgaaatcacttggactgtgaagtatatcacagaatttatcgcaaccgcttttcttatcatcttaggaaatggggctgtagctaacgttgacttaaaaggcacaaaaggaaataattcaggttggattattattgcaattggttatggtttaggtgttatgatgccagcgcttatgtttggtaatgtctctggaaaccatattaacccagctttcacacttggattggcattttcaggtcttttcccttgggcacacgttggacaatacattcttgcacaaattttgggagcaatgtttggacagttagttgtcgttatggtttatcaaccttactttgttaagacagaaaatccaaatcatgttcttggatcattttcaactatttctgcattagatgatggacagaaatcaagtcgtaaagcggcttacattaatggtttcttaaatgaattcgttggttcttttgttcttttctttggagctttggctttaacgaagaactatttcggtgtagaacttgttggtaaacttgttcaagctggttatgaccaaacgacagcagcgacaaggatttcaccatacgtaactggttcacttgctgtagctcacttaggtattggtttcttggtaatgactctagttgcttctttaggtggaccgactggacctgcattgaaccctgcgcgtgaccttggtccacgtattgttcaccgcttattaccaaaacaaattcttggacaagctaaagaagattcaaaatggtggtatgcatgggtgccagttttagcaccaatcgtagcaagtatactcgctgtagccttgttcaaactattatatctttaa

SEQ ID NO: 127 - DNA, 981 bp, Streptococcus agalactiae
atgtcatcttattggaataactatcctgaacttaaaaaaaatattgatgaaaccaatcaactaattcaagaaagaatacaggtcagaaataaagatattgaagcggcgctaagccaactcacagctgcgggaggaaaacagctcagaccagcattcttttaccttttttctcaacttggtaataaggagaatcaagatactcagcaactaaagaaaatcgctgcttctttagaaatccttcacgttgctacattaatccatgatgatgtcattgatgactcaccactaagacgtggaaatatgaccattcaaagcaagtttggcaaagacatcgcagtttatactggggatttacttttcacagtctttttcgatcttattttagaatctatggctgatacaccatttatgaggattaatgcaaaatctatgcgtaaaattctcatgggagaattggaccagatgcaccttcgttacaatcaacaacaaggtatccatcactatttacgtgcgatttcaggtaagacagccgaactctttaaattagctagcaaagaaggagcttactttggtggtgcagagaaggaggttgttcgtctagcaggccatatcggctttaacattggtatgacattccaaattttggatgatatcctggattatactgcagataaaaaaacatttaataagcctgtcttagaggatttaacacaaggcgtttacagccttcctctacttcttgccattgaagaaaatcctgatattttcaaacctattttagataaaaaaacagatatggctactgaagacatggaaaaaattgcttatctcgtcgtttcccatagaggtgttgacaaagctcgccatctagctcgtaaatttactgagaaagctattagtgacataaataagctaccccagaactctgcaaaaaaacagttgctacaattaactaattaccttttaaaacgcaaaatttaa

SEQ ID NO: 128 - DNA, 1749 bp, Streptococcus agalactiae
atgtttaaaatccctttgtttaaagaattaaagacagatcaatgggtaaaaccatttttcaaacaatataaagtttccttagtaattgctcttttccttggttttatgactttcttttctgccagtgctcttatgtttaattcgggctatctgattagtaagtcagcttcactaccgagtaatattcttctagtatatgttccaattgtactaacacgtgcttttggtattggacgtcctgtttttcgttatatagaacgcctaacgagtcacaattgggtattacgaatgacttcacaactgcgcttgaagctttaccattccttagaaagcaatgctatctttatgaagcgtgattttcgtttaggagatgttatggggcttttagcggaggatattaattatttgcaaaatttgtatcttaggacaatatttccaacgattatagcgtggttattatatagctttattattattgcaacaggcttcttttctctatggtttgctttaatgatgttgctttatttagctattatgatttttctttttccactttggtcgattttagctaatggtgctcgtcagactcgtgaaaaagaattaaaaaatcatctttatactgatttgacggataatgtcttaggtatttcagactggatttttagtcaacgtggtcaagagtacgtcgccttgcatgaacgttcggaaagtgaactaatggctattcagaaaaaaattcgttcctttaataatcgtagagctcttattgtggaattagtttttggctttctagctattttggttattatttgggctagtaatcagtttattggtcacagaggtggcgaagctaactggattgcagcatttgttctaacagtatttcccttgtcagaggcatttgctggtttgtctgctgctgctcaagaaacaaataaatattctgattcaattcatcgtcttaatgaattatcagaaacgtattttgaaacaactcaaaatcaattgcctaataagccatatgatttttccgtcaagaatttaagtttccagtataagccacaagagaaatgggttttgcatcatttagatttggatattaaagaaggagaaaaaattgctattttagggcggagtggttctggcaagagtaccttagctagtctacttcgtggcgacttgaaagcaagtcaagggaagattaccctaggcggtgctgatgtttcaatagttggtgattgcatttctaactatattggagtgatacaacaagcgccctacctttttaatacaaccctgctaaataacattcgcattggaaaccaagatgctagtgaagaagatgtatggaaagttcttgaacgagttggattgaaagagatggtcactgatttatcagatggtctctatacaatggttgatgaagctggacttaggttttcaggtggcgaaaggcatagaattgctttggctagaatcttactaaaagatgtcccaattgttatcttagatgagccaactgttggacttgatcctattactgaacaagccttactaagggtatttatgaaagaattggaaggtaagaccttagtttggattacacatcacttaaaaggtattgaacatgctgatcgtatcttatttatagaaaatgggcaattagagttggaaggttctcctcaagaattgtctcaaagtagtcaacgttaccgtcagctgaaagccgctgatgatggtgatctatga

SEQ ID NO: 129 - DNA, 447 bp, Streptococcus agalactiae
atgaaaaaacttattacagaaaaaaaagtcaacaacgtctcaactgttaactatttgaaactcggtcttgtctcagcaatgtttgctggaggagcattcgtagctcttggttctacacaaggtgtttcagcttcaactttcacagcaccgcaagcaacacatccaaaagcagaacgtcagttaacagattcagaaatctatgaacgtgcccaaaaacaagtgttaccaaaatatatccaaggttctctctcaggtatccttaaccaacattcaacactttacaaacaacaaaacgcagcagtgacaccgcaagtatcaagccccaaagcagaacgtcagttaacagattcagaaatctatgaacgtgcccaaaaacaagtattgccaaaatatattcaaggttctctctcaggtatccttaaccaacattcaactttgaatgcttaa

SEQ ID NO: 130 - DNA, 510 bp, Streptococcus agalactiae
atggaggaaaacatgaacataaaacaattaaagtctaaaacaatgcttggaacagtggctttggtgtccgctttttcatttgcttcaacaaatgcagatgcgaatacatataactatgcagtagatgtagactacctagcaagtgcggaggaaattgctcaagcacatccagctagtaatacgtttccactaggtcaatgcacatggggtgtaaaggagatggcaacatgggcaggtaactggtggggaaacggtggtgattgggctgcgagcgccgcatcagctggttatacagtaggaacacaacctcgcgtgggttctatcgtatgttggactgatggtagttatggacatgtggcttatgttacagctgtagatcctgtcactaataaaattcaggttttagaatctaattatgcaggtcatcaatggattgataattatcgtggttggtttgatccacaaaatacagcgacaccaggggtagttagctacatttatccgaattaa

SEQ ID NO: 131 - DNA, 942 bp, Streptococcus agalactiae
atgaaaattaaccaaatgaaaaaagacgagctttttgaggggttttaccttataaagaaagcagaagttcgtaaaacgcgtgcaggtaaagactttattgcctttacctttcgagatgatactggcgaaatttcaggaaatatgtgggatgcacaaacctataatgtagaagagtttgtagccggtaaaattgttcatatgaaagggcgtcgtgaagtttataatggaactccccaagtcaaccaaattacattaagaaacatcaaagatggtgaacctaatgatcctagagattttaaagaaaaacctccaatcaatgttgacaacgtgagagagtacatggaacaaatgctctttaaaattgaaaatgcaacctggcagcgtgtggtaagagcactttatcgtaaatacaataaggaattttttacctatccagccgccaaaacaaaccaccacgcctttgaatcaggattggcatatcacacggcaacgatggttcgtttggcagatagtattggagatatctatccagaacttaataaaagtttgatgtttgctggtattatgctacatgatttagccaaggtcattgagttatcgggtcctgataatacagaatatactattcgaggtaaccttatcggtcatatttcacttattgatgaggaattaacaaaaatactagcagagcttaatattgatgatacaaaagaagaggttacagtgttacgccatgttattctgagtcaccatggacaattagaatatggaagcccggttcgtcctagaatcatggaggcagaaattatccatatgatcgataacattgatgcaaatatgatgatgatgacaacagctttaaatcgtgtcaacgaaggtgaaatgacaaatcgcatttttgccatggataaccgttctttttataaaccgaacattaaataa

SEQ ID NO: 132 - DNA, 852 bp, Streptococcus agalactiae
atgttggttgacaagaagtggcgttttgaagatagtgcaagttatttcgcttgtcctaaatgtcaaaatcccttgataaaagaaagtaacagcctcaaatgctctgataatcattgttttgatttatccaaatttggatatgttaatcttcttggaggaaagaagatagatgaacattatgataaaaaatcatttgaaaatcggcagcttgtcttagaaaacgggtattataatcatattttagaagctatttcaaaggttttggaaaataattctcagtttcattcggttttagatattggttgtggagagggcttttattctcgtcaattagttaacaagtatgagaagactttcttggcttttgatatttctaaagattcgattcaattagctgctaaaagtgatcaatctaggcttgtgaaatggtttgtttctgatttagctaaccttcctattcaagactcatcaattgatatcattttagacattttttctcctgcaaattataaagaatttaggcgggtactgagtgatgatggtatccttgtaaaggttgttcctgtagctgaacatgtccaagaattgcgagaaaaagctagtcaatacttgaaacagaaagattactctaatcaaaaaattctagatcactttagagaaaattttgaaattatttctgagcagaaagttgttcaaagttataactgttctcaacaagaacgtcaagcttttattgatatgacaccgttgttattcagcgtagataaaacgactattgattgggcgagtatatcagaaattacagtaggtgccttaatagtaattggaaaaaagcgcagtgtatctaaataa

SEQ ID NO: 133 - DNA, 450 bp, Streptococcus agalactiae
atgtgtcttatttgtcaacgtattgaaatgattgaacgaaatgagaatccttattttgtgaaagaatatgaaacgggttatcttgttctgggagaccatcaatattttcaaggttattgcctttttctctctaaaaaacacgtaacagagttacatgaattgcctagagattggcgaaatcagtatctttccgaaatggcagatgcttctgaaatagttgctaaggcttttagagcagataagatgaatattgagagtttgggaaatggagacgctcatctacattttcatctttttccaagaaaaacaggtgatttaaggaactatgggcataatggaaaaggtccagtttggtggtatccttttgagaagatgtatgcagatagtgtcagagcaactggtgcagaaatagaaaaattaaaagagaaattgttagatgtcttaggatag

SEQ ID NO: 134 - DNA, 1188 bp, Streptococcus agalactiae
atgtttagtgatttacgcaaaaaatttgtctttttgaccatgtcaatccttattgtcgttgttctctttctctttgcagtgagtaatcgctacaatcaatattgggatgaatatgatgcatataggattgttaaattagttgccaaaaatgattatttaggaataccaggcgatgaaccgattgctttggtgactatagataaccaaaagatggttaagattcaaagcaataatactgatttgacaaatgatgttatcgaaaaatctagtttgaagctccttgagcaaggaaagaagtcacgaaaatggaagtcttttatatattccataaaagaatataaagataaaacctacaccatagctattatggatttggctagttatgaagtcccttatgcaaggcgttttctaattcttgtttttactatttttggattttgtttattagcagctgtaagtctttatctttctcgatttatcgtagggcctgtagagacagaaatgactcgcgaaaaacagttcgtttcagatgcgagtcatgagctgaagacccctattgcagctatacgagccaacgttcaggttctggaacagcaaattccaggaaatcgttatctggatcatgttgtttcggagactaagcgaatggagtttttaattgaagatttgcttaatttgtctagacttgatgaaaaacgctccaaggtaaatttcaaaaagttaaacttatctgtcttatgtcaagaagtacttctgacatatgaaagtttggcatatgaagaagaaaagtgtttaaatgatacgattgaagatgatgtctggattgttggagaagagagtcagattaagcaaattttaataattcttttggataatgctattaggcattctttgtcaaaatcagaaatccagtttagtcttaaacaggctcgaagaaaagctattctgacaatatcaaatccaagtgctatctattccaaagaggttatggataatctctttgagcgtttttatcaagctaaagatgatcatgcagattctctcagttttggtctaggcttatctattgctaaggcaatcgtggaacgccataaggggagaattagagcatatcaagaaaaagaccaattacgtcttgaagtccagttaccaattgatggattttggaccaataccatgattaattaa

SEQ ID NO: 135 - DNA, 1680 bp, Streptococcus agalactiae
ttgattattctcgataaaaaaagttatgacctcctcttttacctattgaaattagaggaacctgaaacagttatggcaattgccaacgcacttaatcagtctaggcgtaaagtgtattatcacttagagaagataaacgatgcactgcctagcgatgtgcctcagattgttagttatccacgtgtaggaatcttgctaaccgaaaaacaaaaagcagcctgtcgtcttttattagatgaagtaactgattatagttacgtcatgaaaagtagtgagaggttgcagctgtctttagtatctatcgtggtagctaaggaccgcataacgattgataggttgatgcaactaaacgatgtttctcgaaatactatcttaaacgatttaaacgaattaagaagtgagttagcagagaaagaatataatttacagttacaatcaacaaaatgtcgcggttattttttagatggtcacccattgtccattatccagtacttatataagctcttagatgatatctaccataatggaagtagtagttttatagacctttttaatcataaactgtctcaagcttttggtgccagcacatatttttctaaagaggttcttgattattttcaccattatctcttcatttctcaacgaagtctaggtaagaaaatcaacagtcaagatggtcagtttatgattcagattttgccttttatactaatggcttatcgtaagatgcgattaagtcctgaagtacagacctctcttaatagtgattttagcttggtttggcaacgtaaggaatatgagattgctaaagagttggctgatgagctggaagaaaattttcagttatcactggatgagattgaagtgggactagtggccatgcttatgcttagtttccgcaaggaccgtgacaatcatttagagagccaggattatgatgatatgcgagctactctaaccagttttttgaaagaattggaagaacgatatcaccttcactttgttcataaaaaggacttactaagacaacttctaactcactgcaaggcactcttatatcgtaaacgttatggtattttttctgttaatcctttaacagagcatattaaagacaaatatgaagaactttttgccataacctcgtcttctgtaaagcttttagagaaagcttggcaaatcaaattgaccgatgatgatgtagcatatctaacgattcatttaggaggggaacttcgtaatagtcaacaatctcctaataaacttaagttagttattgtatctgatgaaggaatagcgattcagaaacttcttttaaagcaatgtcaacgctacttaacaaacagtgatatagaagctgtttttacaaccgaacagtaccaaagtgtgagtgatcttatgcatgtagatatggttgtctctactagtgacgctttagaatctcgttttccgatgttagtagttcaccctgttttgacagatgatgatattattcgcttgattcgcttttcaaaaaaaggtaactgtgcaaatagtaatcaatttaccaatgaacttgaaaaaacgattgctcaatatgtcaaggaagatagtgaacgctacgtgctgaaatctaagattgagaaacttattcatcaagaattgctccaagacgtccttccccttcaaagtacagtttgttaa

SEQ ID NO: 136 - DNA, 648 bp, Streptococcus agalactiae
atgaaatactttttagatactgccgatgtttctgaaattcgtcgtcttaatcgtttaggaatcgttgatggtgttactaccaatccgactattatttcacgtgaggggcgtgactttaaagaagttattaacgaaatttgccaaatcgttgatggcccagttagtgcagaagtgacaggtttaacttgtgatgaaatggttaccgaagctagagaaatcgctaagtggtcaccaaatgttgttgttaaaattccaatgactgaagaaggtttagcagcagtttcacaattatcaaaagaaggtataaagacaaatgtgacattaatatttactgtggctcaaggtctttcggcaatgaaagctggtgcaacatttattagtccttttgtgggtcgtcttgaagatattggaacagatgcttatgctttgattcgtgaccttcgtcacattattgatttttatggtttccaatctgagattattgctgctagcattcgtggattggcgcatgtggagggcgtcgctaaatgcggtgcgcacattgccactattccagataaaacatttgcatcactatttactcacccgcttactgataaagggattgaaactttcttaaaagattgggatagtttcaagaagaagtag

SEQ ID NO: 137 - DNA, 2448 bp, Streptococcus agalactiae
atgagtcattattccataaaattacaagaagtattcagattggcgcaatttcaagcagcacgctatgaaagtcactatttagaaagctggcatcttcttttagcaatggttttagttcatgattcagtagctggtttgacatttgctgaatatgagtctgaagttgcaattgaagagtacgaagcagcaacaattttagctttaggtagagcaccgaaagaagagattaccaattatcaatttttagagcaatcaccagctttgaaaaagatcttaaagttagcagaaaatattagtatcgtagtaggagctgaagatgtgggtactgaacatgtcttgcttgctatgttggttaataaagatttattagccacacgtatcttagagttagttggctttagaggtcaagacgatggtgaatcagttcgtatggttgatttacgtaaggctctagaacgtcatgccggttttacaaaagatgatatcaaagcaatttatgaattacgtaatcctaaaaaagcaaagtcgggtgcttctttttctgatatgatgaaaccaccgagtactgctggtgatttagctgatttcacacgtgatttatcacagatggcggttgatggggaaattgaacctgttattgggcgtgataaagaaatttcacgtatggtccaagtcttaagtcgtaaaacaaagaataatcctgtcttagttggagatgcgggtgtcggtaaaacagctttggcgtacggtctagcacaacgtattgctaatggaaatattccttatgagcttagagatatgcgtgttctagagttagatatgatgagcgttgttgctggaactcgttttcgtggtgattttgaggaacgtatgaatcaaatcattgcagatattgaagaagacggtcatattattcttttcattgatgaactgcatactattatgggttctggctctggtattgatagcacacttgatgctgctaatattttaaaaccagctttggcccgaggcactttacgcactgttggagcaacaactcaagaggaatatcaaaagcatattgaaaaagatgctgctttatctcgtcgctttgcaaaagttttagtagaagaaccaaatcttgaagacgcatatgaaattctacttggattgaagccagcgtatgaagcctttcataatgttactatttcagatgaagcagttatgactgctgtaaaagtggctcatcgttatttgacaagtaagaatttaccagactcagctatagacttacttgatgaagcttctgccactgtgcaaatgatgattaagaaaaatgctccttcgcttttaacagaagttgaccaagctattttagatgatgatatgaaatctgcttctaaagctctaaaagcaagttataagggtaaaaagcgtaagcctattgccgtaacagaagatcatattatggcaactctcagtcgtctatctggtattcctgttgaaaaattgacacaagctgatagtaaaaaatacctcaatttagaaaaagaattgcataaacgtgttatcggtcaagatgatgcagttactgccattagtcgtgctatccgtcgcaatcaatctggcattcgtactggtaagcgtcctattggttcctttatgttcttgggaccaactggtgttggtaagacagagttagcaaaagccttggcagaagtgttgtttgatgatgaatcagccctaattcgttttgatatgtcggaatatatggaaaaattcgcagcttctcacctgaatggggcacctccaggttatgttggttatgatgaaggaggagagttgactgaaaaagtacgcaataaaccatattcagttttactttttgatgaagttgaaaaagctcatccagatatttttaatgtattattacaagtgcttgatgatggcgttttaacagatagtcgaggacgaaaagttgatttttcaaatactataatcattatgacttctaatttaggagcaactgcattacgtgacgataaaacagttggttttggagctaaggatatcagccatgattatactgctatgcaaaaacgtattatggaggagcttaaaaaagcttatcgaccagagtttatcaatcgtattgatgagaaagttgtattccatagtctcagtcaagataatatgcgtgaagttgtgaaaattatggttaaacctttaattttagcgcttaaagataaaggtatggatctgaaattccagccttcagccttgaaacacttggcagaggatggctatgatatagaaatgggtgctcgtccactgcgtagaactattcaaacgcaagtagaggatcatttatcagaactactattggcaaatcaagtgaaagaggggcaagtaattaagattggcgtatccaaaggcaaattgaaatttgatattgcaaaatcataa

SEQ ID NO: 138 - DNA, 1533 bp, Streptococcus agalactiae
atggtcttagataaagaaatcaaggctcaattagcgcaatatttagatttgctagaatctgatattgtattacaagctgatttaggagataacgataattctcaaaaagtaaaggattttctagatgaaattgtcgctatgtctgatcgcatcagccttgaatcaacacatttaaaacgtcaacctagttttggaattgcaaaaaaagggcatgaaagtcgcgttattttttcaggcttgccaatggggcatgaattcacatctttcattttagctttgttgcaagtctctggtcgcgcaccaaaagttgatgaagatattatcaaacgaattaaggggattgagaaaactatcaatctagaaacttatgtttcattaacttgccataattgtccagatgtcgttcaagcctttaatataatggctgttttgaatccgaatatcactcatactatgattgaaggaggcatgtatcaagacgaagtcaaatcaaaaggtatcatgtctgttcctactgtttataaggaccaagaagaatttacttctggccgtgctacaattgaacagcttttagaacaactagatggacctcttgatgctgaagcatttgctgacaaaggtgtctatgatgttctagttattggtggtggtcctgcaggtaacagtgctgcaatttatgccgcccgtaaagggttaaaaacaggtattttagcagaaacttttggtggacaagttatcgaaacagttggtattgagaacatgattggtacactgtacacagaaggccctaaattaatggctcaaattgaagagcataccaaatcttacgatattgatattatcaagagtcaattagcaactggcattgagaaaaaagaattagttgaggtaacactggctaacggagctattttacaagctaaaactgctatcctagctctgggtgctaagtggcgaaatatcaacgttcctggcgaggaagaattccgcaataaaggtgttacttactgtccacattgtgatggccctcttttcgaaggaaaagatgttgctgttataggtggtggtaattcaggtatggaagctgctttagatctagccggtgtcactaaacatgttacagtcctagaattcttacctgagctcaaagcagaccaagtactgcaagaacgagcagctaaaactgacaatttaactattcttaagaatgttgctactaaagatatcgttggtgaagatcatgtcactggtttaaactataccgatcgtgatacaaacgaagaaaaacacattgatttagaaggtgtttttgtacaaattggtcttgtaccaagtacatcttggctcaaggatagcggcattgaactcaatgaacgtcaagaaattgtcgttgataaatttggctcaacaaatatccctggtatttttgctgcaggtgactgtacagatgctgcctacaagcaaatcattatttccatggggtctggtgccacagctgccattggcgcatttgattatttaatcagacaataa

SEQ ID NO: 139 - DNA, 1896 bp, Streptococcus agalactiae
atgataaaatatcaagatgatttttaccaagcggttaatggggagtgggctaagacagctgttattcctgatgacaaaccaaggacaggtggtttttctgatcttgctgatgacattgaagcattaatgctgtcaacgacagataagtggctggctgatgaaaataaaccaagtgatacgattttaaatcattttattgcttttcataaaatgacagctgattatcaaaaacgtgaagaggtaggagtatcaccagtattaccattaattgaagaatataaaggcctacaatctttctctgagtttgcatcaaaagttgcagaatatgaactagagggtaaaccaaatgaatttccatttggtgtggctcctgactttatgaatgctcaattgaatgtactttgggctgaagcgcctgggattattttaccagatacaacttattatagtgaagataatgaaaaaggaaaggaactccttgctttttggcgtaaaagtcaagaagacctactgcctttgtttggcctttcagaacaggaaattaaagatatcttggataaggttttagcattggatgcaaaattggcacaatatgtcttatctcgcgaagagagttcggaatatgttaaactttaccatccttataactgggaagatttcacaaaattagcacctgaacttccattagatgctattttccaaaagatattaggacaaaaaccagataaagttattgttcctgaagaacgtttctggacagaatttgcatctgactattactcagaatctaattgggaattattaaaggcagatcttattttatcagctgcgaatgcctataatgcttacttaactgatgatattcgtatcaaatcgggagtttacagtcgagctttatcaggcacaccacaagcaatggataagaaaaaagcagcttactaccttgcttcaggaccttacaatcaagctctaggtttgtggtatgcaggagaaaaattctctccagaagctaaagctgatgttgagcataagattgcaacgatgattgatgtctataagtcacgcttagaaaaggcggattggcttgcacagtcaacgcgagaaaaagctattatgaaacttaatgttatcacaccacatattggataccctgagaaactaccagagacttatactaaaaaaatcattgatcctaaactatcgcttgtcgaaaatgctactaatttagacaaaatttcaatagcctatggttggagtaaatggaataaaccagttgatagaagtgaatggcatatgcctgcccacatggtcaatgcgtattatgatccacaacaaaaccaaattgtcttcccagcagccattttacaagaaccattttatgctttagagcaaagttcatcagcaaattatgggggaattggtgcagtgattgcacatgaaatatcacacgcttttgacactaatggagcttcatttgatgaacatggaagtttgaataattggtggactgatgaagattttgaagctttcaaaaaacttacagataaagtagttgagcagtttgatggactggaatcttatggcgcaaaagtcaatggtaaactaacagtatcagaaaatgttgcagatttaggtggagttgcttgtgctttagaagctgcgcagcgtgagtcagatttttcagcgagggatttctttattaactttgcgacaatttggcgtatgaaggcacgtgatgagtatatgcaaatgttagctagtgtagatgttcacgccccagcacaatggcgaactaatattacagtaacgaattttgaagaattccataaagagtttgatgttaaagatggtgataacatgtggcgtccagttgaaaaacgtgttattatttggtaa

SEQ ID NO: 140 - DNA, 1008 bp, Streptococcus agalactiae
atgtctaagattctttttttcggtgaacctctcattcgcatcactccaaaagaaaatgactattttgcagatagtatctcaactaaactattctatggtggctctgaagttaataccgcaagagctctacaaggctttgggcaagatactaaactcctctcagccttacccaataatcccataggtaatagttttcttcaatttttaaaagcacagggtattgatactcattctattcagtgggttggagaacgtgttgggttatattttttagaagattcctttgcttgcagaaaaggtgaggtggtctacgaccgcgatcatagtagtttacatgactttaggataaatcaaattgatttcgatcaattatttgaaggagtttctctctttcattttagtggtattacactatcattggatgagtctatccaagagataacactgcttcttttaaaagaagctaaaaaaagagagataacaatctccttagatctcaattttcgcagtaaactaatttctcctaaaaatgccaaaatccttttttctcagttcgctacctttgcggatatttgttttggtattgaacctcttatggttgactcacaggacactaccttcttcaatcgcgatgaagctacaatagaggacgtcaaagaacgaatgatttcgcttataaatcactttgactttcaagtcattttccatactaaacgtctacaggatgaatggggacgaaaccactaccaagcttacatagcaaatcgtaaacaagagtttgtcacttcaaaagaaatcaccacagctgtaaaccagagaattggaagcggagatgcttttgtggcgggagcgctatatcaactacttcagcactcagacagcaagacagtcattgatttcgctgtcgctagtgcatctttaaaatgtgctttggaaggggacaatatgtttgagaccgttaccgcagttaacaaagtactaaatcaatcgaaagacattattcgttag

SEQ ID NO: 141 - DNA, 585 bp, Streptococcus agalactiae
atgaaaagtcgaaaaaaagataaattggtattgaggttaacaacaacactattggtttttggtttgggtggggtttggttttataattataaaaatgataatgtcgaaccgacagtcactagtgcatcggatcaaacgacgacttttattcaaacgatttctccaacagctattgaaatttctaagacctatgatttgtatgcgtcagtcttattagcacaagctattttggaatcatccagtggacaatcagatttgtctaaggctcctaattataacctctttggcatcaaaggagaatataaaggtaaatctgtccaaatgcctactttagaagatgatgggaaaggcaatatgactcaaatccaagctccttttcgcgcctatccaaattattctgcttcactatatgattatgctgagttagtatctagtcaaaagtatgcatctgtttggaaatcaaatacctcttcttataaggatgctactgcagctctaacaggtctttatgcgacagatactgcttatgctagtaaattaaaccaaattattgaaacctacagtctagatgcttatgataaatag

SEQ ID NO: 142 - DNA, 1338 bp, Streptococcus agalactiae
atggcagacgtgaaggtagtgaataatgaggattctagaggtcaaaagcaagacttaaaggctaaactatttcatattaagatagggtcagttcccctaccagtatatgtttgtttagcattattgattcttctagcaggctttttacaaaaattgccagtcaatatgctaggaggatttgcagttatcttaacaatggggtggttcttagggactatcggagctagcattcctggttttaaaaacttcggtggcccagctattttatctttattagtaccatctattttggtgtttttcaacctcattaataaaaatgttttagaatcaacaaatatgttgatgaagcaagctaactttctttatttttatattgcttgtttagtgtccggtagtattttagggatgaatcggaaaatgttgattcagggattgctaagaatgattttccccatgttattaggaatggtttgtgcgatgatggtagggacatttgtcggtgttattttaggcttagagtggcgacacactttgttttatatcgtaacacccgttttagctggtggtattggtgaaggtattttaccattatcgttaggctatagttcaattaccggtgtagctagtgaacaactagttgctcaactcatcccagccactattattggtaatttctttgccattttatgtactgcactattgaatcgtttgggagaaaagaaaccacacttgtctggtcaagggcaattagtaaggttaaataaaggagaggacatgtcagatattattgctgatcattctggcccaattgacgttaagaaaatgggtggaggtgttttaacagcatgtagtctctttatttttggacatttgttgcagcaattaactggatttcctggtcccgtattaatgattgttgcagcagctattttgaaatatattaatgttattcctagagaaacacaaaatggagctaagcaactttataaatttatttctggtaattttacatttcctctaatggcagggctaggattgctttatatcccgttaaaagatgttgtggcaacgcttagcatacaatatttcatagttgttattagtgttgtatttacagttatttctgttggattctttgtatcgcgattccttaatatgaatcctgttgaagcaggtattatttcagcttgtcaaagtggtatgggaggaacaggagatgttgccattttaagtacagcagaccgaatgaacttgatgccatttgctcaagttgctacgcgtttaggaggagctattactgttatcacaatgacagccattttacgcatgttattctaa

SEQ ID NO: 143 - DNA, 1239 bp, Streptococcus agalactiae
agaggcaaaaaagctggtaaatacacaacatctgatggttacatttttgatgccaaagatattaaaaaagatacaggtacaggttatgtcattccacatatgacacatgagcattgggtaccaaagaaagatttatcagagtcggaattaaaagcagctcaagaatttctttcaggaaaatctgaagcaaatcaagacaaaccaaaaacaggtaaaacagctcaagaaatctatgaggcaattgaaccaaaagcaattgttaaacctgaagatttattatttggaattgcacaagcgacagactataagaatggtacatttgtaattcctcataaagatcattaccattatgtggaattaaaatggtttgatgaagaaaaagatcttttagctgattcagataagacatattctttagaagactatttagctacggctaaatattacatgatgcacccagaaaaacgtcctaaagttgaaggatggggtaaagatgctgaaatttataaggaaaaggactctaataaagcagataaaccaagtcctgcaccaactgataataaatcaacatcaaattctagtgacaaaaacttaagtgctgcagaagtattcaaacaagcaaaaccagaaaaaattgtaccgcttgataaaattgctgctcacatggcatatgcagttggatttgaagatgatcaattgattgttcctcatcatgatcattatcataatgttcctatggcatggtttgacaagggtggtttatggaaagcaccagaaggctatacattacaacaactcttctcaacaattaaatactacatggaacatcctaatgaattaccaaaagaaaaaggttggggacacgacagtgatcataacaaaggctcaaataaagacaataaagccaaaaattatgctccagatgaagaacctgaagattcagggaaagtaactcacaactatggtttttatgatgttaataaaggttcagacgaagaagaaccagaaaaacaagaagatgaatcagagctagatgaatatgaactaggaatggcacaaaatgctaagaaatatggtatggatagacaatcttttgaaaagcaactcatccaattatcaaataaatatagtgtaagttttgaaagctttaattatattaatggtagtcaagttcaagttactaaaaaagatggctctaaagtgcttgttgatattaaaacactaacagaagtgaaataa

SEQ ID NO: 144 - DNA, 1446 bp, Streptococcus agalactiae
atgaatcgtaaaaaaacagttattattagtgctttatcagtagctctatttggtactggtgtaggtgcttaccaattaggtagctataatgcccaaaaatcagacaatagtgtttcttatgtgaaaacagataaatctgatagcaaagcacaagcaacagctgtaaataaaacgcccgaccaaatcagtaaagaagaaggcatatctgcagaacaaatcgttgttaaaattactgacgacggttatgtgacttctcatggagaccattaccattattacaatgggaaagtgccatatgatgccatcattagtgaagaattgattatgaaagaccctagctatgtctttaataaagctgatgtcattaatgaagtcaaagatggttatattatcaaagttaacggtaagtattacctctatcttaaagaaggtagcaaacgaacaaatgttcgtacaaaggaacaaatccaaaagcaacgcgaagaatggtctaagggtggttctaagggagaatcaggaaagcatagtagtgcaaaaactcaagctttatcagccagcgtacgtgaagcgaaagctagcggtcgctatactacagatgatggttatgtttttagtccaacagatgtcattgatgacatgggagatgcctttttagtaccacatggcgatcatttccattatatcccgaaagctgatttatctccatcagagttatcagccgcacaggcatattggaaccgcaagactggccgatcaggtaatagctcaaaaccatcaaattcaagttcatacattcatgcaagtgcaccaagcggtaatgtatcaacaggaagacatgctaatgcccctatttctattccaagagtcactcacgcaaatcactggtcaaaaccagctggtaatcatgctacggcaccaaaacaccatgcacctacaaccaaaccaatcaacaaagattctgctttagacaaaatgttgaaacgtttatatgctcaaccgttatatgctcgtcacgtagaaagtgatggtttggtttatgacccagcacaagttaatgctttcacagcaatcggtgtttctattccgcacggtaatcatttccactttattcactataaggatatgtctccattagagttagaagcaacaaggatggtggcagagcatagaggacatcatattgatgcattagggaaaaaagattctacagagaaaccaaagcatatttctcatgaacctaataaggaacctcacacagaggaagaacaccatgcagtaacaccgaaagaccaacgtaaaggcaaaccaaatagccagattgtctacagtgctcaagaaattgaagaggcaaaaaagctggtaaatacacaacatctgatggttacatttttgatgccaaagatattaaaaaagatacaggtacaggttatgtcattccacatatga

SEQ ID NO: 145 - DNA, 471 bp, Streptococcus agalactiae
atggctaaatttggatttttatcggtactagaagaagaattggataagcatttacagtatgactttgccatggattgggataagaaaaatcatactgtagaagtcacttttatattagaagcacaaaacagctctgctattgaaaccgtggacgaccagggggagacgagtagcgaggacatcgtttttgaggactatgtactcttttacaaccctgtcaagtctcgctttgatgctgaggactatctggtgactatcccctatgagcctaagaagggcttgtcgcgtgagtttctggcttattttgcggagactctcaacgaggttgccactgaagggttgagcgacctcatggacttcctcaccgatgacagtatcgaagagttcggtctttcttgggatacggatgcttttgaaaatggcagagcagaactgaaagagacagagttttacccttatccgagatattag

SEQ ID NO: 146 - DNA, 4713 bp, Streptococcus agalactiae
atgaacacaaaacagcgtttttcaatccggaaatataagttaggtgccgtatctgtacttttgggaaccctattttttttaggtggtatcacaaatgtagctgctgattctgtcataaataagccatctgatattgcagttgaacagcaagtaaaagacagtccaacgagcatagcaaatgagacacctactaacaacacgtcatcagcccttgcgtcgacagctcaagacaatcttgttacaaaggctaataatagtccaacagaaacacaaccagtagctgagtctcactctcaagccaccgagacattttccccagtcgcaaatcaaccggttgaaagcactcaagaagtttctaaaactcctttaaccaaacaaaatttagcagtcaaatctacaccagctatttctaaagaaacccctcaaaacattgatagtaataaaattatcactgtccccaaagtatggaacacaggctacaaaggagagggaactgttgtagcaattattgactcaggactagatatcaatcacgatgctctccaattaaatgattcgacaaaagcaaaataccaaaacgaacagcaaatgaatgctgctaaagcaaaagctggtataaactatggaaaatggtataacaacaaagtaatctttggtcacaactatgttgatgtcaatacagagctaaaagaggtgaaaagcacttctcatggtatgcacgtaaccagtatcgcaacagctaatcctagcaagaaagatacaaatgaattaatctatggtgttgctcctgaagcacaagtaatgtttatgagagtcttctctgatgaaaaaagaggaactggaccagccctttatgttaaagctattgaagatgccgttaaactcggtgctgacagcattaatttaagtttaggtggagctaatgggtctttagttaatgccgatgaccgacttataaaagctttagagatggctagactcgctggcgtttctgttgttatagcagcaggtaacgacggtacatttgggagtggagcatcaaagccttctgctctttatcctgattatggtttagttggtagtccatcaacagctcgtgaggccatttctgtagcatcatataataatacaacactggttaataaagtcttcaacattatcggattagaaaacaacagaaatctcaacaacggattagctgcttatgcagatcctaaagttagtgataagacctttgaagtagggaaacaatatgattatgttttcgtaggaaaaggaaacgacaatgattataaggacaaaactttaaatggtaaaatcgccttaattgaacgtggagatattacttttacaaaaaaagtcgtcaatgctattaatcacggtgctgtgggagctattatctttaataacaaagctggggaagctaatctaacaatgagtttagatcctgaagcaagtgctattcctgctatttttacccaaaaagagtttggagatgttttagctaaaaacaactataaaattgtatttaacaatatcaaaaataaacaagccaaccctaatgcaggtgtcctatctgacttttcaagctgggggttaacagcagacggacaattaaaacctgacttatctgctcctggaggctctatttacgccgctatcaatgataatgaatatgatatgatgagtgggacaagtatggcttctccccatgtcgctggtgctactgctctagttaaacaatacttattgaaagaacatccagaacttaaaaaaggtgacattgaaagaactgtcaaataccttcttatgagtactgctaaagcacacctaaacaaagatacaggcgcttacacctcaccacgccaacaaggagcaggtattatcgatgtcgcagcagcagttcagacaggattatacctaactggtggggaaaacaactatggcagcgttacattaggaaatattaaagataaaatttcctttgatgttactgttcataatatcaataaagttgcaaaagatttacactatacaacctatttaaatactgatcaagttaaagatggctttgtcacattggctcctcaacaacttggtacatttacagggaaaacgatacggattgaaccagggcaaacccaaacgattacaattgatatagatgtttcgaaataccatgacatgttaaaaaaagtaatgccaaacggctatttcctagaaggctacgtacgttttacagaccctgttgatggtggggaagttcttagtattccttatgttggatttaagggagaattccaaaacttagaagttttagaaaaatccatttataagcttgttgctaacaaagaaaagggattttatttccaaccaaaacaaacaaacgaagttcctggttcagaagattatactgccttaatgactacaagttcagagcctatctactcaacagacggtactagtcctatccaattgaaagccttgggaagctataagtctatagatggaaaatggatcttacaactagatcaaaaaggccagcctcatctagccatttcacctaatgatgaccaaaatcaagatgccgttgcagtgaaaggtgttttcttacgtaatttcaataatttaagagccaaagtctatcgtgcagatgatgttaatttacaaaaaccactatgggtaagtgctccccaagcaggagataaaaattactacagcggaaatactgaaaatccaaaatctacatttttatatgacacagaatggaaaggaaccactactgatggtattcctttagaagatggaaaatacaaatacgttttaacttattactctgatgtccctggctctaagccacaacaaatggtgtttgatatcactttggatagacaagctcctacactaacaacagcaacttatgacaaagatagacgtatcttcaaagctcgtcctgcagtagaacacggggaatctggtatctttagagaacaagtttgttacttaaaaaaagataaagatggtcattataatagcgtcttacgtcaacaaggagaagacggtatccttgttgaagataacaaagtatttatcaaacaagaaaagaatggtagctttattctacctaaagaggttaacgatttctctcatgtctactatactgttgaagattatgcaggcaatctagtatcagcaaaactcgaagatttgatcaatattggcaataaaaatggtttagtaaacgtcaaagtgtttagccctgagcttaacagtaatgtcgatattgatttctcttactctgtcaaagatgacaaaggtaatatcatcaaaaagcaacatcacgggaaagacctcaatttattgaaattgccttttggtacctatacgtttgatctattcttatacgatgaggaacgagcaaatctaatcagtcccaaaagtgtcactgtaactatttctgaaaaagatagccttaaagacgtcttatttaaagttaacttactcaagaaagcagccttactcgttgaatttgacaagcttttaccaaaaggagcaacagtccagttggttactaagacaaatactgttgttgatctaccaaaagcaacttattctcctactgactatggtaaaaacatacctgtaggagactatcgtttaaacgtaacgctgcctagtgggtatagcactttagagaacttagatgatttacttgtatccgtaaaagaagatcaggtaaacctaacaaaattgacgctgattaataaagctcctctgattaatgccctagcagaacaaactgatattattacccagcctgtgttttataatgctggaactcacttaaaaaataattacctagctaatcttgaaaaggcacaaactttaattaaaaatagagtggaacaaacaagtattgataatgctattgctgctttgagagaaagtcgccaagctcttaacggtaaagaaacagatacttctttactggcaaaagctattttagctgaaacagaaatcaagggaaactatcaatttgttaatgctagtccattaagccaatcaacttatatcaatcaagtccaattggcgaaaaaccttctacaaaaacctaacgtcactcaatcagaagtagacaaagccttagaaaatcttgatattgctaaaaatcaattaaatggtcatgaaactgattactctggtttacaccatatgataattaaagcaaacgttctgaaacaaacatcatctaaatatcagaacgccagtcaatttgctaaagaaaattataataaccttatcaagaaagcagaattgctgctttccaatagacaagctacacaagctcaagttgaagagttattaaaccaaataaaagcaaccgaacaagagcttgatggccgtgatagagtttcttccgcagagaattatagtcaatcactcaatgataatgactctctcaataccacacctatcaatccgccaaatcagccccaggcgttgatattcaaaaaaggcatgactaaagaaagtgaggttgctcagaagcgtgtcttaggggtgactagccaaaccgataatcaaaaggtaaagacaaacaagcttcctaaaacaggcgaaagcactcctaaaataacctatacaatattgctatttagtctctctatgctaggtctggcaacaatcaaactaaagtctatcaaaagagaataa

SEQ ID NO: 147 - DNA, 1932 bp, Streptococcus agalactiae
atgaataataacgaaaaaaaagtaaaatactttttaagaaaaacagcttatggtttggcctcaatgtcagcagcgtttgctgtatgtagtggtattgtacacgcggatactagttcaggaatatcggcttcaattcctcataagaaacaagttaatttaggggcggttactctgaagaatttgatttctaaatatcgtggtaatgacaaagctattgctatacttttaagtagagtaaatgattttaatagagcatcacaggatacacttccacaattaattaatagtactgaagcagaaattagaaatattttatatcaaggacaaattggtaagcaaaataaaccaagtgtaactacacatgctaaagttagtgatcaagaactaggtaagcagtcaagacgttctcaagatatcattaagtcattaggtttcctttcatcagaccaaaaagatattttagttaaatctattagctcttcaaaagattcgcaacttattcttaaatttgtaactcaagccacgcaactgaataatgctgaatcaacaaaagctaagcaaatggctcaaaatgacgtggccttaataaaaaatataagccccgaagtcttagaagaatataaagaaaaaattcaaagagctagcactaagagtcaagttgatgagtttgtagcagaagctaaaaaagttgttaattccaataaagaaacgttggtaaatcaggccaatggtaaaaagcaagaaattgctaagttagaaaatttatctaacgatgaaatgttgagatataatactgcaattgataatgtagtgaaacagtataatgaaggtaagctcaatattactgctgcaatgaatgctttaaatagtattaagcaagcagcacaggaagttgcccagaaaaacttacaaaagcagtatgctaaaaaaattgaaagaataagttcaaaaggattagcgttatctaaaaaggctaaagaaatttatgaaaagcataaaagtattttgcctacacctggatattatgcagactctgtgggaacttatttgaataggtttagagataaacaaactttcggaaataggagtgtttggactggtcaaagtggacttgatgaagcaaaaaaaatgcttgatgaagtcaaaaagcttttaaaagaacttcaagaccttaccagaggtactaaagaagataaaaaaccagacgttaagccagaagccaaaccagaggccaaaccaaatattcaagtacctaaacaagcacctacagaagctgcaaaaccagctttgtcaccagaagccttgacaagattgactacatggtataatcaagctaaagatctgcttaaagatgatcaagtaaaggacaaatacgtagatatacttgcagttcaaaaagctgttgaccaagcttatgatcatgtggaagagggaaaatttattaccactgatcaagcaaatcaattagctaacaagctacgtgatgctttacaaagtttagaattaaaagataaaaaagtagccaaaccagaagccaaaccagaggccaaaccagaagctaagccagaagctaagccagaagctaagccagaagctaagccagaggccaaaccagaagctaagccagacgttaagccagaagctaaaccagacgttaaaccagaggctaagccagaagctaaaccagaggctaagtcagaagctaaaccagaggctaagctagaagctaaaccagaggccaaaccagcaaccaaaaaatcggttaatactagcggaaacttggcggctaaaaaagctattgaaaacaaaaagtatagtaaaaaattaccatcaacgggtgaagccgcaagtccactcttagcaattgtatcactaattgttatgttaagtgcaggtcttattacgatagttttaaagcataaaaaaaattaa

SEQ ID NO: 148 - DNA, 1623 bp, Streptococcus agalactiae
atggcaaaagatattaaattttcagcagatgcccgctcagcaatggtgcgtggtgttgatattttagctgatacagtcaaagtaacattaggtcctaaaggccgtaatgttgttcttgaaaaagcatttggttctcctttaattacaaatgatggtgtgacaattgctaaagaaattgagctagaagatcactttgaaaatatgggagctaaacttgtgtcagaagtggcttcaaaaactaatgatattgcaggggatggcactacaactgctactgttttgacccaagctattgtacgggaaggtcttaaaaatgtaactgcaggggcaaatccgattggcattcgtcgtggtattgaaacagctgtttcagcagcagttgaagagctaaaagagattgcacaaccagtttcaggcaaagaagctattgctcaagttgcggctgtgtcttcacgttctgaaaaagttggggaatacatttctgaagctatggggcgcgtgggtaatgatggtgttatcactattgaagaatcgcgaggtatggaaacagagcttgaagttgtggaaggaatgcagtttgaccgtgggtacttgtcacagtatatggtaactgataacgagaaaatggtctctgaacttgagaatccgtatatccttattacagataagaaaatttcaaatatccaagaaattttaccattattagaagaggttcttaaaacaaatcgtccgttgctaatcatcgctgatgatgttgatggagaagctctcccaacgcttgttcttaacaaaattcgtggaactttcaatgtcgtagctgttaaagcgcctggatttggtgatcgtcgtaaagccatgctggaagatattgctatcctaacaggaggaactgtcgttactgaagaccttggtttagacttaaaagatgctactatgcaagttttaggacagtctgctaaagtaacagtagataaagattctactgttattgtcgaaggtgccggtgactcatcagcaattgctaatcgcgtagctatcattaagtcacagatggaggctacaacttctgattttgatcgtgaaaaattacaagaacgacttgctaagttagccggtggtgtagcagtaattaaagttggtgcagcgactgaaacagaattaaaagagatgaaacttcgcatcgaagatgcgttaaatgcaacgcgtgctgcagttgaagaaggtattgtttcaggtggaggtacggctcttgtgaacgttattgaaaaagtagcggcactgaaacttaatggtgatgaggagactggacgtaatattgttcttcgtgctctcgaagagcctgttcgtcaaattgcttacaatgctggatatgaaggttcagttattattgaacgtttaaaacagtctgaaattggtacaggatttaatgcggccaatggagaatgggtagatatggttaccacaggtatcattgaccctgtcaaagtaacacgttctgcacttcaaaatgcggcatctgtagcaagtcttatcttgactacagaagcagtagtagcaaataaacctgaaccagaagctcctacagctcctgcaatggatccatctatgatgggtggcttctaa

SEQ ID NO: 149 - DNA, 1542 bp, Streptococcus agalactiae
gtggtagaaaacctagaaaaaccaattggagtgagctataaaaatagcccatcaatgagtaaacgaacggctatcagaatgaagaaatctagtcgattttcaattttactatatagtgttttgtcaactctcttagcaattgcaaatcctttattgacttattttgcaaatggtttgcagactcagaatctctatacaggtttgatgatgaccaaaggacagatcccttatagtgatgtttttgctacaggaggatttttatactatgtaacgattgctctaagttaccttttagggtctagtatctggttacttattgtacagtttattgcttactatgtatctggaatttatttttataaattagtttattatgtggcacaaagtgaaattgtctcgataggcatgacgttgattttctatataatgaatattgtcttaggattcggtggtatgtacccaatacagtgggcattaccttttatgctcatttcgctatggtttttaattaaattttgtgtcgataatatcgttgatgaagcatttatattttatggcattttagcagcattctcactatttatagatccccaaacactgattttttggctttgctcttttgttctcttaacagcaaccaatattaagcaaaagcagtcactacgaggattttatcagtttttatgcgttgtttttggtatgattttaattgcttatactgttggttactttatgtttaatctacagattatctcttcttatattgacaaagctattttttacccctttacgtatttcgctaggacaaaccactcattccttcttagtttagcaattcaaattgttgtccttctagggtcaggttgtctctttggactatgggattttattcaaaatcgtaaaaaagcatcttatcaaatcggcttgaactttattgcctgtatttttattatttacgctataatggccattttttcaagagattttaacctttaccactttttacctgctttaccatttggtcttttgctaacgagtaataaaattactattctttaccaaaaagtgattgacagacgttcacatagacgtcagtatttctctggtaaatctcttatcgtagacctttttgtaaagaaaacatattatttgcccctcttactagtttccttatcgatagggttactagtttataatacttatcaaaatgttactcttagtaaagaaaggcgtgacatttcacattatttgactacaaaaattgatagagatggtaagatttatgtttgggacaaagttgctagcatttatagccagactcggttaaaatctgcttctcaatttgttttgccacatattaatacagcgcaaaaaaataatgagaaaattttgaaggacgagctgcttcagcatggggctaaatactttatcttaaataaaaatgagaagttaccaaatgaactgaaatctgatattaagaagcactaccaagaagttcctctatcaaatatcactcattttgttctatatcgtttcaaatag

SEQ ID NO: 150 - DNA, 2577 bp, Streptococcus agalactiae
atggccaagccaacgatatcaccgggaatgcaacagtatctggatataaaagagaattatccagatgcttttttgctttttagaatgggtgatttttatgaattattttatgatgatgcggtaaaagcagcacaaatcctggaaattagcttgactagtcgaaataagaacgcagaaaagccaatcccaatggcaggagttccctatcactcagctcaacagtatattgacgttttagttgaattaggttacaaagtagccattgctgagcagatggaagatcctaaaaaagctgtgggagtggtcaagcgtgaggtagtgcaagttgttaccccaggaacggttgtggagtcaacgaagccggatagtgctaataatttcttagtagcgattgattcgcaagatcaacaaacatttggtctagcatatatggatgtctcaactggagagtttcaggcaacccttttaacagattttgagtccgtccgtagtgaaatactaaatttaaaagctcgtgagattgtagtaggatatcaattgacggacgaaaaaaatcacctactgacgaagcagatgaacttgcttttatcatacgaagacgaacgacttaatgatattcatttgattgatgagcagttaactgatttggaaatatctgctgcggaaaaacttttacaatatgtgcatagaacacaaaagcgtgaacttagtcatttacagaaagtagttcattatgaaataaaggactatttacaaatgtcatatgcaacgaaaaatagtctagatttactggagaatgctagaacaagcaagaagcatggaagtctttactggttgttagatgagactaaaacagcgatgggaactcgaatgctgagaacttggattgacaggcctttggtaagtatgaatcgaatcaaggaacgtcaagatattattcaagtgtttcttgattatttttttgagagaaacgatctcacagaaagtttaaagggtgtatatgatattgaacgcctagcaagtcgagtatctttcggaaaagccaaccctaaagatctattgcaactcggacagaccttatcacaaattcctcggattaaaatgattttacagtccttcaatcaacctgagcttgacatcattgtcaacaaaattgacactatgcctgaattagaaagtttaattaatacggcgatagccccagaagcacaggctactatcactgagggaaacattatcaagtctggatttgataagcaattggataattatcgaacagtgatgcgtgaaggtacaggttggattgctgatattgaagctaaggaaagagcagcaagtggtatcggtactcttaaaattgattataataaaaaagacggttattacttccatgttaccaattccaatttatcactagtaccggagcattttttccgtaaagcgacattaaaaaattctgaacgctatggaacagcagaactagccaaaattgaaggtgaaatgctcgaagctcgcgagcaatcttcaaatttagaatatgatatttttatgcgtgttcgtgcccaagtagaatcttatattaaacgtcttcaagagttagcaaagacgattgcaaccgttgatgttctacagagtttggcagtagttgcagaaaattatcactatgttcgtcccaaatttaatgatcaacatcagattaagattaagaatgggcgtcatgcaactgttgaaaaagtgatgggagtgcaagaatatattcccaatagcatctattttgatagtcagacagatatccagttgattacaggaccaaatatgagtggtaagtcgacctatatgcgccagttagctttgacagttattatggcacaaatgggaggttttgtatcggcagacgaagttgatttgcctgtatttgatgcaatatttactaggattggtgctgctgacgacttaatttctgggcaatcaacctttatggtagaaatgatggaagcgaatcaagctgtaaaacgagccagtgataaatctttgattctttttgatgaattaggtcgagggacagccacttatgatggtatggcattagctcaatcgattatagaatatattcatgaccgtgttagggcaaaaacaatgtttgcgactcattaccatgagttgacagatttatctgaacagttgacaaggcttgtcaatgtacacgtggctactttagagagagatggagaagttaccttcttacataaaattgaatctggacctgcggataagtcttatgggatacacgtcgcaaaaatagctggtttaccaattgacttattggatagggcaactgatattttatcacagttggaagctgatgcagtacagttgatcgtatcgccctcccaagaagctgttactgctgacttaaatgaggaactagattctgagaagcaacaaggacaattatcgctttttgaagaaccttcaaatgcaggtagggttattgaggagttagaagcgatagatataatgaatctaactccaatgcaagctatgaatgctatatttgacttaaagaaattattataa

SEQ ID NO: 151 - DNA, 873 bp, Streptococcus agalactiae
atgttgaaactggatttaaaaacaaagataaaagaagctattttaattgcctttggtgtggctctctatactttcggctttgtcaaatttaatatggctaatcatttggctgaaggaggtatttccggtgtcactttgattatccatgcacttttcggagttaatccagcactttcatcacttctccttaatatcccgttatttatattaggggctaggattttagggaaaaaatccttattattaactatatatggtacagtgttaatgtcttttttcatgtggttttggcaacaaatccctgtaacagtccctttgaaaaacgatatgatgttagttgcagtagctgctggaattttagcaggaactggtagtggtttagtatttagatatggtgcaactacaggtggtgcagatattattggtcgtattgtagaggaaaaatctggaataaaattagggcaaaccttattgtttattgatgctatagttctaacgtcttcacttgtttatattaatttacaacagatgctatatacgttagtagctagctttgtatttagtcaagtgttaacaaatgttgaaaatgggggctacactgttcgtggaatgatcattattaccaaagaatcagaatctgcagcagcaaccattttgcatgaaattaataggggtgtaacttttttacggggccaaggtgcctactcaggtagagagcatgatgtcttgtacgtagctcttaacccaagtgaagtgcgtgatgtgaaagaaatcatggctgatttagacccagatgcttttatttctgttataaatgtagatgaagttattagctcagattttaaaattcgacgaagaaattacgataaataa

SEQ ID NO: 152 - DNA, 1752 bp, Streptococcus agalactiae
atgaaacgtagtatgtatgctgggcgtgttcgtagtgagcacataggaacatcgattactttaaaaggatgggttggtcgtcgtcgtgaccttggaggccttatttttattgatcttcgcgatcgcgagggaatcatgcaattagttattaatcctgaagaagtagcagcctcagttatggcaaccgcagaaagtctccgtagtgaatttgttatagaggttagcggtgtagtgacagcacgagaacaagctaatgataatttaccaacaggagaagttgaattaaaagtgcaagaattatcggttcttaatacctcgaaaacaacaccatttgaaattaaagatggtattgaggcaaatgatgatacacgcatgcgttaccgttacttggatcttcgtcgtccggaaatgcttgaaaatttcaaattacgtgcgaaagtaacacactcaatccgtaattaccttgacaacttagagtttattgatgtcgaaactccgatgctaacaaaatcaactccagagggggcacgagactatttggttccatcacgtgtcaaccaaggacatttttatgcccttccacaaagccctcaaattacaaaacagctattgatgaatgcaggatttgatcgttattatcaaattgtcaaatgttttcgtgatgaggatttacgtggagatcgtcaacctgagtttacacaagttgacttagagacatcattccttagtgatcaagaaattcaagacattgttgagggtatgattgctaaagtaatgaaagacactaaaggtttagaggtttctttaccattcccaaggatggcatatgatgatgcaatgaataactacgggtctgataagcctgatacaaggtttgatatgcttttacaagacttgacagaaattgtaaaagaagttgacttcaaggtgttctcagaagcttcagtagttaaagcgattgttgtcaaagacaaggcggacaagtactctcgaaaaaatattgataaattaacagaaattgcaaaacaatacggtgccaaaggtttagcatggctaaaatatgtagataatactatttcaggtccggttgctaagttcttgacagctattgaaggtaggttgacagaagctttgcagctagagaataatgacttaattctatttgtagcagatagtcttgaagtagctaacgagactttaggagcgcttcgtacacgcattgcaaaagaacttgaactcattgattattctaaatttaatttcctatgggttgttgattggccaatgtttgagtggtcagaagaagagggacgatatatgtcggctcatcatccattcaccttgccaacagcggagacagcgcatgagttggaaggggatttggctaaagtacgtgcagttgcctatgatattgttttgaatggatatgagttaggcggtggtagcctacgtattaaccaaaaagatacacaagagcgtatgttcaaggctttaggatttagcgctgaatcagctcaggaacagtttggtttcttacttgaagctatggattacggcttcccaccacatggtggattggcaataggccttgaccgctttgttatgttgttagcaggcaaggacaatattcgagaagttattgcattccctaaaaacaataaggctagtgatccaatgactcaagctcctagtctcgtttcagaacaacaattagaagaattatcacttactgtagaaagttatgaaaactag

SEQ ID NO: 153 - DNA, 456 bp, Streptococcus agalactiae
aaagaaaaaggaaaactaataaagaaaaaaattctagaaaataatactgatattattccaaaaattatagaaaaaagtcctcaaaatcttattcttacaagtaattacaacagagttaatattgataaaataaaaaatataaaaaattttgataaaggattcgaactaggctttccactttttgaaaaaggagaaattctgagaaaagaaggcgaaataactagtgcaattgaattatttgataaagcacgtgaactaggatattttgtacccgccttatacaattcttatgcgatggcttttaggaaaataaagaattatgatgatgaaattctaatactacaagaaggaattgaaagattcaaaaaaagcaccctgtcatcaaatattaacccaaagacaatcgatagatggagtactcgtatttctagagctaaagatttaaaatgtaaataa

SEQ ID NO: 154 - DNA, 678 bp, Streptococcus agalactiae
ttgaatgtaaaaaaacatcatttagcttatggagctatcactttagtagcccttttttcatgtattttggctgtaatggtcatctttaaaagttcacaagttactactgaatctttgtcaaaagcagataaagttcgcgtagccaaaaaatcaaaaatgactaaggcgacatctaaatcaaaagtagaagatgtaaaacaggctccaaaaccttctcaggcatctaatgaagccccaaaatcaagttctcaatctacagaagctaattctcagcaacaagttactgcgagtgaagaggcagctgtagaacaagcagttgtaacagaaaacacccctgctaccagtcaggcacaacaagcttatgctgttactgagacaacttatagacctgctcaacaccagacgagtggccaagtattgagtaatggaaatactgcaggggctattggctcagcagctgcagcacaaatggctgctgcaacaggagtccctcagtctacttgggaacatattattgcccgtgaatcaaatggtaatcctaatgttgctaatgcctcaggagcttcaggacttttccaaacgatgccaggttggggttcaacagctacagttcaggatcaagttaattcagctattaaagcttatcgtgctcaaggtttatcagcttggggttactag

SEQ ID NO: 155 - DNA, 1482 bp, Streptococcus agalactiae
atgtcaaattgggatactaagtttttgaaaaaaggttttacttttgatgatgttctgcttattcctgctgaaagccatgttttaccaaatgaagttgatatgaagacaaagttggctgataatttgacattaaacattccaatcattacagctgcaatggatacagttacagatagtaagatggctattgctattgcacgtgctggtgggcttggtatcattcataaaaatatgtcaatagttgatcaagcagaagaagttcgtaaagttaaacgctcagaaaatggtgttattattgacccattcttcttgacaccagataatactgtctctgaagctgaggaattgatgcaaaactatcgcattagtggagttcctattgtagagacactcgagaatcgtaaattagttggaattattactaaccgtgatatgcgtttcatttctgattataaacaactaatctcagagcacatgacaagtcaaaatcttgtaacagctcctattggtacagatcttgaaactgcagagcgtattcttcatgagcatcgtattgaaaagctacctttagtagatgatgagggacgtctttcaggacttattactattaaggatatcgaaaaagttattgaatttcctaaggcagcaaaagatgaatttggacgtctcttagttgcaggtgcagtaggtgtaacctctgatacttttgaacgtgcagaagctttgtttgaagcaggtgcagatgctattgtcattgatacagcacatggacattcagctggtgtgctccgtaaaattgctgaaattcgtgctcacttccctaatcgcacattgattgcgggaaatattgctacagcagaaggagcgcgtgcactttatgatgcaggtgtggatgtcgttaaagttggtattggtccaggttcaatttgtacgactcgtgtcgttgctggggtaggtgttcctcagattacagctatttacgatgcagcggctgttgcgcgtgagtacggtaagactatcattgctgatggtggtattaaatattcaggtgatattgtaaaagcacttgcagcaggtggaaatgcagttatgctaggttcaatgtttgcaggaacagatgaagcgccaggagaaacagaaattttccaagggcgtaagttcaagacataccgtggtatgggctcaattgcagcaatgaaaaaaggttcaagcgatcgttatttccaaggttctgtaaacgaggctaacaaattggttccagaaggtattgaaggtcgtgtagcatacaaaggttcagtagccgatattgttttccaaatgcttggtggcattcgctctggtatgggatatgtaggtgcagcgaacataaaagaacttcatgataatgctcaatttgttgaaatgtcaggagctggcttgaaagaaagccatccccatgatgttcaaattacaaatgaggcaccaaattattcagtacactaa

SEQ ID NO: 156 - DNA, 2580 bp, Streptococcus agalactiae
atgacaattaaccactataagcttcgtataccttactatacaataagctttctacttcccttcataatcatagtctgtatcctctttactaagaatatttattggggaagtccaacaaccatattagcaagcgatggctttcatcaatatgttatctttaatcaagcattaagaaatattcttcatggttcaaacagcttattctatacctttacaagcggtttaggtttaaatttttatgctctgagtagttactatttgggaagttttttatccccaatagtttatttctttaacctaaaaaatatgcctgatgctatctaccttttaacaatatgtaaaatagggttgataggtttgtcaatgtttgtcactctttgtaaacgtcattgtaaagttaatcgtgtcttacttttagtaatttctacttgctatagcttaatgagtttctcaattagccaaattgaaattaatatgtggctagatgtatttattctaattccccttgttgttttaggagttgatcagctactatgggaaagaaaacctatactttatttcctctctctgacagccttattcatccaaaactattattttggttttatgactgccatctttactagcctttacttcatcgtacaaataacccgtaatactgatagtaaggttgcatttaaacaatttcttcattttacctttttatctcttttagctggtatgactagtagcattatgattttgccaacttattttgatttaactactcatggtgaaaagttgacaaaggtatcgaagatgtttacagaaaattcttggtacatggatttgtttgctaaaaatatgattggagcctatgatacaacaaaatttggctctattcctatgatttatgtaggtttacttcctttactcctttctttactttactttacaataaaggaagttcctcgaaggactagattagcatatggatttttaataatatttgttattgctagtttttatataacacctctagatttattttggcaagggatgcatgctccaaatatgtttctccatcgctactcttgggtactttcagtacttatctgtctgctagctgctgaatgccttgagtatttagacaacatttcttggaaaaagattttaggggtcaatttaattttagtaagtggtttcataatcacgtttttatttaaaaagcattatcattaccttaatcttgaattacttcttttaaccttaactttcctctcagcttatattattctaactattagttttgtcagtaagcaaatccctaaattagttttttatccctttcttattggttttgttgtattagagatgacattaaacaccttttaccaactaaatagtcttaacgatgaatggatatttccatctaggcaaggatatgctaaatataatcacagcattagcaaacttgtcagaaagactgagagaaataactctacattcttccgtacagagcgctggttaggacaaaccggcaacgactctatgaaatataattataatggtatttcacaattttcatctattagaaatcgttcttcaagtcaagtgcttgatagacttggctttaaatcagatggtacaaatttaaatttacgttatcaaaataatactttgatcgcagatagtctatttggtgtgaagtataaccttacagaatatccttttgataaatttggttttatcaaaaaagctcaagataaacaaaccattctttacaaaaatcagtttgccagtcaattagctatactaacgaatcaagtatatcaagataaaccatttactgtgaatactttggataatcagacaactcttttaaatcaattaagtggtttgaaagagacgtattttgagcatcttattccaaatagcgtttctgggcaaaccactcttaataaacaagtatttgttaaaaagaataaacaagggaatactgaaattacctataacataactatccctaaaaacagtcagttatatgttagtatgccgtttataaattttaataatgaggaaaataaaattgttcaaatctccgttaataatggaccatttgtacctaatactcttgataatgcttattcattttttaatattggttcctttgctgaaaacagtcgtatcaaagtaaaatttcaatttccacacaatgatcaagtttctttcccaattcctcacttttatgggctcaagttagaagcttatcaaaaagctatgactgttattaataaacgaaaagtaaaagtaagaactgatcacaataaagttattgctaattatacaagtcctaatagaagttctcttttcttcactattccctatgataggggttggaaagcttatcaaaataataaagaaataaaaattttcaaagctcagaaaggttttatgaaaataaatattcctaaaggaaaaggcaaagtaacattaatttttatcccttacggctttaaatttggggtaggcctatctattactggaatagtattatttactgtctattattttaaatttggaaaaaataaaataggatga

SEQ ID NO: 157 - DNA, 45 bp, Streptococcus agalactiae
tggtttatgaagcactcggttgggaagcgccacaatttggtcaca

SEQ ID NO: 158 - DNA, 90 bp, Streptococcus agalactiae
atgaaagatcacctaaggtgcttcctccattaccgatccaaaaacgttgggaaaaatggaacgagattgaagggaggaaagcctaatgac

SEQ ID NO: 159 - DNA, 99 bp, Streptococcus agalactiae
gacaaacagcttttccaatgcgtgcagggcttccaaataaggaacctcaatggcaagaagcatgggatcaagctgatatttataaaaaacgtcaagcat

SEQ ID NO: 160 - DNA, 78 bp, Streptococcus agalactiae
aacgaggaagccatagatggggtgtccaagcttgggaaaaaaatcaccattctaggaaataattcatacctttcttcc

SEQ ID NO: 161 - DNA, 93 bp, Streptococcus agalactiae
atcaaacaatggctattggtgatgaagaaaatgaccgtgctatgcttgaagttgttggaaatcctgttgttatgcaaaacggcaatcctgaac

SEQ ID NO: 162 - DNA, 57 bp, Streptococcus agalactiae
aggcgcatttcaaacaatctaggagttttaaaggaagcgaccgttatacacgccgta

SEQ ID NO: 163 - DNA, 108 bp, Streptococcus agalactiae
gagctctgcctaaagctgagcaacgtcaagccaatctatatgccttggcacttcgagcaaatcagtttgaaaaaacaggtttcaagggtttatcacgctttattcgaa

SEQ ID NO: 164 - DNA, 96 bp, Streptococcus agalactiae
agaagctgcttcagtaggtgctatccaagatttaacagattcagatatcattttctcaaaccaccgtggacacggacaaactattgcaaaaggtat

SEQ ID NO: 165 - DNA, 57 bp, Streptococcus agalactiae
agatggtttggttttagatatgacgatggcagaaaatttagctttacaaacttatta

SEQ ID NO: 166 - DNA, 66 bp, Streptococcus agalactiae
cccttaaaaagtttgtcgatgacatcaagaatgaagctattgaggttatcacaaagaaaagctatg

SEQ ID NO: 167 - DNA, 90 bp, Streptococcus agalactiae
aggcacttgcgaaagagacaaaagcaaaatcatttaatgaatttatgctttctatgtgccgtgaaaaaattgaaaaaggacaatttaatt

SEQ ID NO: 168 - DNA, 90 bp, Streptococcus agalactiae
aagttatttattcagcctattcaggaaaatatgaagcagccaatcgagattatatcaaattactatgcaaagcttgggttaatgaaaatc

SEQ ID NO: 169 - DNA, 57 bp, Streptococcus agalactiae
tatcaaacgtattcgaaaaaggcaagaaaatttggttccgtttggcttaaacctaag

SEQ ID NO: 170 - DNA, 84 bp, Streptococcus agalactiae
acgctgttattccagatacttctcctgctttctcatttgaaaaagaacatctttctggagtggaatatgcacgctacttacaat

SEQ ID NO: 171 - DNA, 210 bp, Streptococcus agalactiae
aagaagttttacgaaataatattagcaaccaagtaccacacatcagtgttcaaatggagtttaaaactcaagaacaagttgacgaataccaaaaaaatctcggaagcatcatccgggaaattggagatacacttggaacagcaactgaattcaatgccaaaagtaacattagcacttatactcttggtggacaaatccaacgcattattg

SEQ ID NO: 172 - DNA, 333 bp, Streptococcus agalactiae
ttaaagcaaatgttccgtcgcgtattgcatttgctgtttcaagtggtactgatagccgtacgatccttgatgaaaatggtgctgaaaagctcttgggacggggtgacatgctctttaagcctattgatgagaatcatccagtacgactacaaggttcctttatttcagatgatgatgttgaaaggatcgttggttttatcaaagaccaagccgaggctgactatgatgatgcctttgatcctggagaagtatctgaaacagataacggctctggtggtggcggcggagtacctgaaagtgatcctctttttgaagaagccaagggactcgttt

SEQ ID NO: 173 - DNA, 39 bp, Streptococcus agalactiae
ggccggaaaattaattttagtcgtccatcacgatttgag

SEQ ID NO: 174 - DNA, 81 bp, Streptococcus agalactiae
agagttaagtataaaaaatgggaacctttatcaatatcccgttcctgctatgaaaaatcttcgtcaacatcaagcagaatt

SEQ ID NO: 175 - DNA, 93 bp, Streptococcus agalactiae
acttggtcaagatgttgtattcccaggtgttactcgtggtgcaaaattagaagaagcaatcaatgctttggaagatggacaagttcttttggt

SEQ ID NO: 176 - DNA, 99 bp, Streptococcus agalactiae
aaggagaatttcgttcaaaggttgaggagtctattgaaagcaatcagcaaaaatataatcatttatagtctagtttctctaccattagctagacacttg

SEQ ID NO: 177 - DNA, 177 bp, Streptococcus agalactiae
agtataatcaatattaaactagaaatatatgacatatgtcctaaaactatctcaaatagggagtcaatacatggatatagaaaactactgccaagactactgtttggagactatctttccaaaacattatttcaaggatttacaagtaatcaccctaactgccggccaatccgtctg

SEQ ID NO: 178 - DNA, 48 bp, Streptococcus agalactiae
ctttctttcagaagaagtcggcgaattggctcaagccattcgcaaata

SEQ ID NO: 179 - DNA, 42 bp, Streptococcus agalactiae
ttcattttcaaggataggtttaaaatgagacacttcacggac

SEQ ID NO: 180 - DNA, 222 bp, Streptococcus agalactiae
gggttgatttgtgcttgtaaagcctttatctctgccatactggctaacttattttgttcctctgttatccccattgccagttgtcctgaaaatatttgcgctaaaccaaggactaggttttcctccacctcagacattgtcttatctcctgcaaagtacatttttaaggcacccacagttttatcatttatttttagaggaactacaatagcagaatttaac

SEQ ID NO: 181 - DNA, 99 bp, Streptococcus agalactiae
tcctcctctttggacacccattacaaacatagggagcttttcttagtagcggacagtctaggcagtctttggttgattctcttagttgcttatttcgtt

SEQ ID NO: 182 - DNA, 75 bp, Streptococcus agalactiae
cacctggtgcccactcaatatcataaacagaatctacctcttgaatataagaggctaaacgctctagtccataag

SEQ ID NO: 183 - DNA, 72 bp, Streptococcus agalactiae
gcacacctacacgaagggtatcataagtatccactaaaaagacgcaatctttatgagtttctgcgtaagctt

SEQ ID NO: 184 - DNA, 69 bp, Streptococcus agalactiae
ccattgaaagagctccgcgaacattatataattcctcggaaaattcgtcttcaaaactttccccataga

SEQ ID NO: 185 - DNA, 63 bp, Streptococcus agalactiae
aagtatactattgcaggctctcgtgtcacccagcgtcgaccatcattttctgttactaaagta

SEQ ID NO: 186 - DNA, 57 bp, Streptococcus agalactiae
gcagctttttcatcaccagcagctaaaaacagagcattcattacaacacgatcttca

SEQ ID NO: 187 - DNA, 141 bp, Streptococcus agalactiae
tccatggttaaacaaatatcgttctctgaccatttgatatcacgttttgaaggcttatgcttgaggcgattttctgtgcgattccgtttgagacgctcacttagctctgtttctaattctacaaataatacctcttggttg

SEQ ID NO: 188 - DNA, 129 bp, Streptococcus agalactiae
taccacgttctttctcgatatcatttgaatccattgcacgttcttcaagctctttacgctcatcaagagtatgtgattgttttaataattcatcaacgagagttgttttaccgtggtcaacgtgggcaa

SEQ ID NO: 189 - DNA, 54 bp, Streptococcus agalactiae
gcacagccttcttcaactaggatatcccctaaaattgatcgttttacacctaag

SEQ ID NO: 190 - DNA, 114 bp, Streptococcus agalactiae
tggaatagaactatcaattattttttgaataacctgcaattggtgactaatatcaagttgcccacgagaaaaattttccagtcccaaaacaagtttctgagcttcatcaaaaac

SEQ ID NO: 191 - DNA, 36 bp, Streptococcus agalactiae
gtccaagaaggccataaaattttccctcttcaaaga

SEQ ID NO: 192 - DNA, 87 bp, Streptococcus agalactiae
caacaaagcaataacaccgccaattatagtcgcccctataaaccttggcataaaaagaaaaatggattgagctgcagatgctttagc

SEQ ID NO: 193 - DNA, 249 bp, Streptococcus agalactiae
ttctttgatgataccaaagttaacattcattggttggaaatgtttgctgtctgtatgtgtaatataatgtggcagtgcaccaatagcagtagtttgtgggaaaactacttcactctccccattaaagcgacgggcagcattgattcccgctacaagaccacttgctgccgattctacataaccttcaacaccggtcatttgtccagcaaagaaaagatttgggttcttacgtgtagcaaaggtttggtc

SEQ ID NO: 194 - DNA, 243 bp, Streptococcus agalactiae
gtgtattcgttacgcatagcgacattggaactagaacgaaacttgatagacaagcgacgtgggaaaccaaccgattctaggtcaatagagtttttagaggttagtttagcaatattatcttgcaagaataagttaatacctgacatcatgctagagaagacatttcccttagtttcttctgaagcgaagtcagaagacctaaagtttaaatcagccatatctctaaatttggaaaattgttct

SEQ ID NO: 195 - DNA, 168 bp, Streptococcus agalactiae
ggccatagcaatggcattaaagagggaaatggaggtatcttcccagtattttgcattgccattaccgctaccaggtttcgttttacgataaatggcttctgcaaccgcattaacccttgtctgtgtcatttcatagtaacccttcttagctgctgcaatcgcaagagc

SEQ ID NO: 196 - DNA, 489 bp, Streptococcus agalactiae
agaatagagaaggctatcgtccctaaaccggccattagtgttctgatgataatctcaaggatggtattaggaacaccagaaaaagaacctgtcatttgttctgcaaacggaataatttcaattgtaatagccacacctgctgatatagaaatacaaatgagtaaagcagacataatcaaagctaaacctgttgaaaaattattctgtgaaaattctctcaccgaattaacaaaggcagcccctggcaccataaccattagtgcccctaatataataatgctacgatgctcacctaatcctgaaaaatataataaattagcacttaaagccactacagaactacctagaatggtcaaaagaaatcctgtatgtatacgactttccatcaaattcagaaaatatcctaaaattaagcctgttacagcagcggaaaatgaatctaataaggaactacctaaggctaaagaaaaactacccgctccacaaaaa

SEQ ID NO: 197 - DNA, 267 bp, Streptococcus agalactiae
ccatattctgtaacatatgctgctccagtaatttgtaatggagcggatttagcacgacgaacagcatatgctatgtcgtcatcagttacaaaaccttctgatgtagaagaattagttaccataggtgatagaacaaaacgattttctaggctcaatccattgggaagtattaatggacgaaataaattaccttggacattattcatctctgctcaccgtccccttattagccatagacttagcctgaaatctatcaaactctgcaac

SEQ ID NO: 198 - DNA, 54 bp, Streptococcus agalactiae
gccaaccataatgacaaaaataatacgataagcgttaataaatttagtgccaaa

SEQ ID NO: 199 - DNA, 153 bp, Streptococcus agalactiae
tccttctgcgtattttgttgccattccaaaaaaggcagctacccacatccaaaacaaagctcctggtcctccagatttaatagccgtagccacaccaacgatattacctgtccctaccgttgcagcaagagcagttgcaagggcagcataact

SEQ ID NO: 200 - DNA, 90 bp, Streptococcus agalactiae
acattaggcatttcttttaaaataagagggtgccatttctccgcaaaaccttttctagggggtaaatctcctgattttcctttgcctggg

SEQ ID NO: 201 - DNA, 180 bp, Streptococcus agalactiae
tttaatatttctaatagttccttaggttttggtacttctgctaaatcagcaagtacttcctcagctaattcttccttaataatttcttgtgataaggccacacattcattacaaatgaaaacaccattacctgcaataattttttttacttcatcttggcttttgccacaaaatgaacaa

SEQ ID NO: 202 - DNA, 105 bp, Streptococcus agalactiae
ggtgtttataaaaagcagagcctaagcctgattttccatcagattcacctgattgtttatcattttgattttttgcatgataggtttgtgccttattatcgagaa

SEQ ID NO: 203 - DNA, 261 bp, Streptococcus agalactiae
attttcttacgatcagtatgtggaaattcacgacaagctttaggtctgacatcgtatatactacataagttatcatcgcctaaaaacggacaaggcatcgctttaaatactttatctccatcttcatctacttctaaaaataaatcttcaaaagccgataacttcatccggaaatgtttagaaatcctagaaatatcagcttctgtaaatagaggacccaaagttttacaacaattagcacatgctgtacaatcaatttct

SEQ ID NO: 204 - DNA, 390 bp, Streptococcus agalactiae
agtagaataagtacaataacaataccaataaggataagcccaacttttttatatagagaggacttttcttcaggacttaaaggatcgtttggtctgagactctcttcagtcaaatatttttttccatctaaggtatattggaggagaccaaagaacataccaatagcagcaagtgagaaaccaagatggaaatttacttcttgtccgaggtaccccactacaatgggtgaaataaaagcaccaaggttaataccaaaaacaaagatactaaaaccagcatcacgacgagaatcattttctccatataaattaccaaccatctctgatacatttggttttaatagtccagtaccaaggataattagagcaatcgaaatgaatagagctgtt

SEQ ID NO: 205 - DNA, 78 bp, Streptococcus agalactiae
tcttttcctcgttcaaataatttatgtgcttttaaagataagttcaaatgtcgcacaagttctcgattagactgttta

SEQ ID NO: 206 - DNA, 123 bp, Streptococcus agalactiae
atccattcatttcatagaaggaaattaaatcatcatggcaagttaaacttataccatctcgttcttgagaaacaaccaggtctttcatcgctgctaataatgctgtaccaatcccctgacctt

SEQ ID NO: 207 - DNA, 465 bp, Streptococcus agalactiae
ctgtctttttcgatagtatcccatttattaactacaataataatacctttaccagcttcatgtgcaaaccctgcaatacgcttgtcatactcacgaataccttcctctgcattaatcaccataagaacaacatctgagcggtcgatggcgcgcatagaacgcataacagaatatttctctgtgttttcatataccttaccagatttacgcataccagcagtatcaatcatagtatactcttgcccctggctatcaacgaaattagtatcaatagcatcgcgcgtagtaccagcaactgggctagcaataacacggtcttccccaaggatggcattaattaaactagatttcccaacatttggacgtccaatcaaactaaaacgaataatatctggattttcattttcctcttctaccggaagattttccacaatagcatccaatatatcaccagtaccaatacca

SEQ ID NO: 208 - DNA, 72 bp, Streptococcus agalactiae
tgcccatcctcagatatagctggaattaattttaccaaaaatagcggaaaaatagataaacaaaccgttaca

SEQ ID NO: 209 - DNA, 96 bp, Streptococcus agalactiae
ccctttctcagaaatcatttccataacaacgagaccagcaccaaattctttagcgatagtacgaaaagcagaattggtaatacctgccatcggtgc

SEQ ID NO: 210 - DNA, 150 bp, Streptococcus agalactiae
gcgtcgacaggatcagcagcgaatccacagactacgccaggaaaactattacaagcaagcatcgctccaattcctgtcccacagcctgtaataacaaaatctgcagcaccgctattaagtaaaatagcagtcagtaaaccattttgtaca

SEQ ID NO: 211 - DNA, 141 bp, Streptococcus agalactiae
gcaatgcctaaacgttgcttcataccaccggagtatgatgaaatcttctttttacctacatcgcctaaaccaacaagctctagtaatctaggaatttcttgtttagctttctttttatcaacaccttttaaggtagcgata

SEQ ID NO: 212 - DNA, 147 bp, Streptococcus agalactiae
cttttactgattttaaaaaatccagatactacacataacaccaccataaaaagacaacctaacaaaccccctaaagttttacgaaaaagaactgaaaaaaagagtattaagcttatgaaaagaataccgataaaccatgttgcaccg

SEQ ID NO: 213 - DNA, 132 bp, Streptococcus agalactiae
aatttcaaagcacgaccaccaggtgttgtttcagggttaccaaacataacgcctactttttcccttaactggttgataaaaattgcgattgtctttgtcttgttaatggatgctgacaatttacgcattgct

SEQ ID NO: 214 - DNA, 141 bp, Streptococcus agalactiae
aaaagagtagggatttgccacatatatcatgtatcccaatccagctgtttccacaacaataaatttagccgttattttactcaattttcctttaatataatcgtacattctattttcctatctcaatatttttcattttgg

SEQ ID NO: 215 - DNA, 237 bp, Streptococcus agalactiae
aattcaacgacaagtgcttcattgatttctgggttaatttcatcgcgttctggaaggcgagtcaatgaaccttcaagtttttcagcatcaaatgatacgaaagctggacgtcctaaagtagcttcaacagcttcaaggattgcaggtactttcattgatttttcacgaactgaaataacttgtcctggagtaacgcggtatgatgggatatcaacacgtttaccatcaacaaggata

SEQ ID NO: 216 - DNA, 111 bp, Streptococcus agalactiae
acaagacccttagtagaaatcttagttgataaactagcgccatataaggaagctaacttttctcgaaattcttgtaccttaggatacttagcatttgcagtaactaacatt

SEQ ID NO: 217 - DNA, 861 bp, Streptococcus agalactiae
agaactcgaaatgcaattagatatcctaaagcaagcagcggtgattatggcacaaaaagggaaataatcactgctaataaggataaatacagcatttcaaagatgtgtcgctggctgaatatgccacgctcaagttattactatcaagccgtggagtcagtatctaaaacggagtttgaagaaactattaaaagaatttttctcgatagcgagtctagatacggatccagaaaaatcaaaatatgcttgaataacgaaggtatcacactttcacgtcgtcggattcgacgcattatgaagcgactcaatttggtttctgtttatcagaaagccaccttcaaaccacattctagaggcaagaatgaagcccctattcccaaccacttagacaggcaatttaagcaagaaagaccactacaagccttagtcactgacttaacctatgttcgtgtaggcaatcgttgggcttatgtttgcctcatcattgacctatacaaccgtgaaatcatcggcctgtctcttggttggcacaagaccgctgaactcgttaagcaagccatacaaagcatcccttacgccctgaccaaagtcaagatgttccattcagatcgtggcaaagagtttgataatcagttaattgatgaaatattggaagcctttggaatcacacgttcgcttagtcaggctggttgtccttatgacaatgccgtagctgaaagtacgtatcgtgctttcaaaattgaatttgtttatcaagaaacctttcaatcgctggaagaactagctcttaagactgaaaaggcaacacttttctgtacaacatttataaagtgttgccttttcaggtttttaccaatgcta

SEQ ID NO: 218 - protein, 428 aa, Streptococcus agalactiae
MKKVLTFLLCSLYFVSIPAISTEEPLTLSQNRRYALTQTVVDKEMYFDAIPERPTTKIEISSFQDEALTITGETLVPNTLLSIVSLTINSNGIPVFTLSNGQFIKASREAIFNDLVSKQQSVSLDYWLKPSFVTYEAPYTNGVSEVKNNLKPYSRVHLVEQAETEHGIYYKTDSGFWISVEDLSVADNRMAKVQEVLLEKYNKDKYGIYIKQLNTQTVAGINIDRSMYSASIAKLATLYASQEQVKLGKLSLDSKFEYKDNVNQFPNSYDPSGSGKLEKKADHKLYTVKELLEATAKESDNVATNMLGYYVNNQYDSMFQTQVDTISGMHWDMKKRQISPQAAGKMMEAIYYQNGDIVNYLSKTDFDNTRIPKNIPVKVAHKIGDAYDYKHDAAIVYAEQPFIMIIFTDKSSYDDITKIADDVYQVLK

SEQ ID NO: 219 - protein, 447 aa, Streptococcus agalactiae
MKKRILSAVLVSGVTLGTAAVTVNADDFDSKIAATDSVINTLSGQQAAAQNQVTAIKGQVGALESQQSELEAQNAQLEAVSQQLGQEIQTLSNKIVARNESLKKQVRSAQKGNLTNYINTILNSKSVSDAVNRVVAIREVVSANEKMLAQQEADKAALEAKQIENQNAINTVAANKQAIENNKAALATQRAQLEAAQLELSAQLTTVQNEKASLIQAKAQAEEAARKAAEAQAAAEAKAQAEAKAQAESVAKAQAAAQVESATAPTETVQTQPRTEIKPSNLTATSSATTVATTTATATNEPKVTQPSVVTKAVEAPKAVVSSTPRAVSKPVVRSYDSSNTYPMGQCTWGAKSMASWVGNYWGNANQWGASARAAGYSVGTTPRVGAVAVWPYDGGGYGHVAVVTSVANNSSIQVMESNYAGNMSIGNYRGSFNPSASGSVYYIYPN

SEQ ID NO: 220 - protein, 1241 aa, Streptococcus agalactiae
MNKRIFVEKKADFDIKSASLVKELTHNLQLTSLKDLRIVQVYDVFNLAEDLLARAEKHIFSEQVTDCLLTETEITAELDKVAFFAIEALPGQFDQRAASSQESLLLLGSDSQVKVNTAQLYLVNKDIAEAELEAVKNYLLNPVDSRFKDITLPLEEQAFSVSDKTIPSLDFFETYKADDFAAYKAEQGLAMEVDDLLFIQDYFKSIGRVPTETELKVLDTYWSDHCRHTTFETELKNIDFSASKFQKQLQATYDKYIAMRDELGRSEKPQTLMDMATIFGRYERANGRLDDMEVSDEINACSVEIEVDVDGVKEPWLLMFKNETHNHPTEIEPFGGAATCIGGAIRDPLSGRSYVYQAMRISGAGDITTPIAETRAGKLPQQVISKTAAHGYSSYGNQIGLATTYVREYFHPGFVAKRMELGAVVGAAPKENVVREKPEAGDVVILLGGKTGRDGVGGATGSSKVQTVESVETAGAEVQKGNAIEERKIQRLFRNGNVTRLIKKSNDFGAGGVCVAIGELADGLEIDLDKVPLKYQGLNGTEIAISESQERMSVVVRPSDVDTFIAACNKENIDAVVVATITAKPNLVMTWDGETIVDLERRFLDTNGVRVVVDAKVVDKDLTVPEVRTTSAETLEADTLKVLSDLNHASQKGLQTIFDSSVGRSTVNHPIGGRYQITPTESSVQKLPVQHGVTTTASVMAQGYNPYIAEWSPYHGAAYAVIEATARLVATGADWSRARFSYQEYFERMDKQAERFGQPVSALLGSIEAQIQLGLPSIGGKDSMSGTFEELTVPPTLVAFGVTTADSRKVLSPEFKAAGENIYYIPGQAISEDIDFDLIKANFSQFETIQAQHKITAASAVKYGGVLESLALMTFGNRIGASVEIAELDSSLTAQLGGFVFTSAEEIADSVKIGQTQAAFTLTVNGNDLAGASLLSVFEGKLEEVYPTEFEQADALEEVPAVVSDTVIKAKETIEKPVVYIPVFPGTNSEYDSAKAFEQVGASVNLVAFVTLNEAAIADSVDTMVANIAKANIIFFAGGFSAADEPDGSAKFIVNILLNKKVRAAIDSFIEKGGLIIGICNGFQALVKSGLLPYGNFEEAGETSPTLFYNDANQHVAKMVETRIANTNSPWLVGVEVGDIHAIPVSHGEGKFVVSASEFAELRDNGQIWSQYVDFDGQPSMDSKYNPNGSVNAIEGITSKNGQIIGKMGHSERWEDGLFQNIPGNKDQALFASAVKYFTGK

SEQ ID NO: 221 - protein, 434 aa, Streptococcus agalactiae
MKMNKKVLLTSTMAASLLSVASVQAQETDTTWTARTVSEVKADLVKQDNKSSYTVKYGDTLSVISEAMSIDMNVLAKINNIADINLIYPETTLTVTYDQKSHTATSMKIETPATNAAGQTTATVDLKTNQVSVADQKVSLNTISEGMTPEAATTIVSPMKTYSSAPALKSKEVLAQEQAVSQAAANEQVSPAPVKSITSEVPAAKEEVKPTQTSVSQSTTVSPASVAAETPAPVAKVAPVRTVAAPRVASVKVVTPKVETGASPEHVSAPAVPVTTTSPATDSKLQATEVKSVPVAQKAPTATPVAQPASTTNAVAAHPENAGLQPHVAAYKEKVASTYGVNEFSTYRAGDPGDHGKGLAVDFIVGTNQALGNKVAQYSTQNMAANNISYVIWQQKFYSNTNSIYGPANTWNAMPDRGGVTANHYDHVHVSFNK

SEQ ID NO: 222 - protein, 300 aa, Streptococcus agalactiae
MLKHFGSKVRNLRVTRNITREDFCGDETELSVRQLARIESGQSIPNLTKAHYIAKQLNVKLDILTGGESLELPKRYKELKYKLLRTPTYGDANRLAVREAYFDEIYEVFYEELPEDERLIIDCMQSKLDVHFSVNDNFGITILHDYFDQIKKKKEYTTNDFVMIDLYLLCFSINYGMKSLYSLENYHFIMSKLLEQDNLLPEDNFQLNNVLLNHVELAFQFKQKKYVQQIIHRSNAIMTEIHDFQKRPILSLIEWKYLLIIEKDRTKAETCFKQSILFAELIGDLYLKGKLIEEWNKDLT

SEQ ID NO: 223 - protein, 880 aa, Streptococcus agalactiae
MTEKTKAVETTDVALAIDTLVQNGLKALDEMRQLNQEQVDYIVAKASVAALDAHGELALHAVEETGRGVFEDKATKNLFACEHVVNNMRHTKTVGVIEEDDVTGLTLIAEPVGVVCGITPTTNPTSTAIFKSLISLKTRNPIIFAFHPSAQESSAHAARIVRDAAIAAGAPENCVQWIEQPSIDATNALMNHDGIATILATGGNAMVKAAYSCGKPALGVGAGNVPAYVEKSANIRQAAHDIVMSKSFDNGMVCASEQAVIIDKEIYKEFVEEFKSYHTYFVNKKEKALLEEFCFGAKANSKNCAGAKLNPNIVGKSAVWIAEQAGFTVPEGTNILAAECTEVSEKEPLTREKLSPVIAVLKAESTEDGVEKARQMVEFNGLGHSAAIHTKDADLAREFGTRIRAIRVIWNSPSTFGGIGDVYNAFLPSLTLGCGSYGRNSVGDNVSAINLLNIKKVGRRRNNMQWFKVPSKTYFERDSIQYLQKCRDVERVMIVTDHAMVELGFLDRIIEQLDLRRNKVVYQIFAEVEPDPDITTVMKGTDLMRTFKPDTIIALGGGSPMDAAKVMWLFYEQPEVDFHDLVQKFMDIRKRAFKFPELGKKTKFVAIPTTSGTGSEVTPFAVISDKANNRKYPIADYSLTPTVAIVDPALVMTVPGFIAADTGMDVLTHATEAYVSQMANDYTDGLALQAIKIVFDYLERSVKDADFEAREKMHNASTMAGMAFANAFLGISHSMAHKIGAQFHTVHGRTNAILLPYVIRYNGTRPAKTATWPKYNYYRADEKYQDIAKLLGLPAATPEEAVESYAKAVYDLGTRLGIKMNFRDQGIDEKEWKEKSRELAFLAYEDQCSPANPRLPMVDHMQEIIEDAYYGYEERPGRRK

SEQ ID NO: 224 - protein, 277 aa, Streptococcus agalactiae
VGIKVYKPTTNGRRNMTSLDFAEITTNTPEKSLLVSLKNKAGRNNNGRITVRHQGGGHKRHYRLIDFKRNKDGVEAVVKTIEYDPNRTANIALVHYTDGVKAYILAPKGLEVGQRIISGPEADIKVGNALPLANIPVGTVIHNIELQPGKGAELIRAAGASAQVLGQEGKYVLVRLQSGEVRMILGTCRATIGTVGNEQQSLVNIGKAGRNRWKGVRPTVRGSVMNPNDHPHGGGEGKAPVGRKAPSTPWGKPALGLKTRNKKAKSDKLIVRRRNQK

SEQ ID NO: 225 - protein, 312 aa, Streptococcus agalactiae
MIEFEKPIITKIDENKDYGRFVIEPLERGYGTTLGNSLRRVLLSSLPGAAVTSIKIDGVLHEFDTIPGVREDVMQIILNVKGLAVKSYVEDEKIIELDVEGPAEITAGDILTDSDIEIVNPDHYLFTIAEGHSLKATMTVAKNRGYVPAEGNKKDDAPVGTLAVDSIYTPVKKVNYQVEPARVGSNDGFDKLTIEIMTNGTIIPEDALGLSARVLIEHLNLFTDLTEVAKATEVMKETEKVNDEKVLDRTIEELDLSVRSYNCLKRAGINTVFDLTEKTEPEMMKVRNLGRKSLEEVKIKLADLGLGLKNDK

SEQ ID NO: 226 - protein, 308 aa, Streptococcus agalactiae
MKKIRLSKFIKMIVVILFLISVAASFYFFHVAQVRDDKSFISNGQRKPGNSLYAYDKSFDKLLKQKIEMTNQNIKQVAWYVPAAKKTHKTAVVVHGFANSKENMKAYGWLFHKLGYNVLMPDNIAHGESHGQLIGYGWNDRENIIKWTEMIVDKNPSSQITLFGVSMGGATVMMASGEKLPSQVVNIIEDCGYSSVWDELKFQAKEMYGLPAFPLLYEVSTISKIRAGFSYGQASSVEQLKKNNLPALFIHGDKDNFVPTSMVYDNYKATAGKKELYIVKGAKHAKSFETEPEKYEKRISSFLKKYEK

SEQ ID NO: 227 - protein, 148 aa, Streptococcus agalactiae
MSKVRGFELVSQFSNKELLPKRETAHAAGYDLKVAKKTVIEPGEITLVPTGIKAHMQPGEVLYLYDRSSNPRKKGIVLINSVGVIDGDYYNNQVNEGHIFAQMQNITDQAVILEEGERIVQAVFAPFLLADDDQATGMRTGGFGSTGK

SEQ ID NO: 228 - protein, 322 aa, Streptococcus agalactiae
MKFGKKLGFLALLMSIVLILGACGKTGLGNSTGNSTKNVTKKSAKNLKLGVSISTTNNPYFVAMKDGIDKYASNKKISIKVADAQDDAARQADDVQNFISQNVDAILINPVDSKAIVTAIKSANNANIPVILMDRGSEGGKVLTTVASDNVAAGKMAADYAVKKLGKKAKAFELSGVPGASATVDRGKGFHSVAKSKLDILSSQSANFDRAKALNTTQNMIQGHKDVQIIFAQNDEMALGAAQAVKSAGLQNVLIVGIDGQPDAHDAIKKGDISATIAQQPAKMGEIAIQAAIDHYKGKKVEKETISPIYLVTKDNVEKYNW

SEQ ID NO: 229 - protein, 396 aa, Streptococcus agalactiae
MGKEKLILAYSGGLDTSVAIAWLKKDYDVIAVCMDVGEGKDLDFIHDKALTIGAIESYILDVKDEFAEHFVLPALQAHAMYEQKYPLVSALSRPIIAQKLVEMAHQTGATTIAHGCTGKGNDQVRFEVAIAALDPELKVIAPVREWKWHREEEITFAKANGVPIPADLDNPYSIDQNLWGRANECGVLENPWNQAPEEAFGITKSPEEAPDCAEYIDITFQNGKPIAINNQEMTLADLILSLNEIAGKHGIGRIDHVENRLVGIKSREIYECPAAMVLLAAHKEIEDLTLVREVSHFKPILENELSNLIYNALWFSPATKAIIAYVKETQKVVNGTTKVKLYKGSAKVVARHSSNSLYDENLATYTAADNFDQDAAVGFIKLWGLPTQVNAQVNKG

SEQ ID NO: 230 - protein, 62 aa, Streptococcus agalactiae
MAKVCYFTGRKTVSGNNRSHAMNQTKRTVKPNLQKVTVLIDGKPKKVWVSARALKSGKVERV

SEQ ID NO: 231 - protein, 551 aa, Streptococcus agalactiae
MAKQKNNWRRVGVGVLTLASVATLAACGSKSASQDSNGAINWAIPTEINTLDLSKVTDTYSNLAIGNSSSNFLRLDKDGKTRPDLATKVDVSKDGLTYTATLRKGLKWSDGSKLTAKDFVYSWQRLVDPKTASQYAYLAVEGHVLNADKINEGQEKDLNKLGVKAEGDDKVVITLSSPSPQFIYYLAFTNFMPQKQEVVEKYGKDYATTSKNTVYSGPYTVEGWNGSNGTFTLKKNKNYWDAKNVKTKEVRIQTVKKPDTAVQMYKRGELDAANISNTSAIYQANKNNKDVTDVLEATTAYMQYNTTGSVKGLDNVKIRRALNLATNRKGVVQAAVDTGSKPAIAFAPTGLAKTPDGTDLAKYVAPGYEYNKTEAAKLFKEGLAESGLTKLKLTITADADVPAAKNSVDYIKSTWEAALPGLTVEEKFVTFKQRLEDSRKQNFDIVVSVWGGDYPEGSTFYGLFKSDSQNNDGKFANKDYDAAYNKAISEDALKPEESAKDYKEAEKILFEQGAYNPLYFRSGKGLQNPKLKGVIRNTTGLSIDFTHAYKK

SEQ ID NO: 232 - protein, 242 aa, Streptococcus agalactiae
MELLKTPIFGICFSLILYTIGQHLFKKSKGFFLLQPLFFAMVSGIVILWLMSKGLGTDVKTFYTQAYKPGGDLIFWFLNPATIAFAVPLYKKNDVVKKYWVEILSSLVIGMIVSLMLIVAISKMVGLSQVGIASMLPQAATTAIALPITAAIGGNTAVTAMACILNAVIIYALGKKLVSFFHLNDSKIGAGLGLGTSGHTVGAAFALELGELQGAMAAIAVVVIGLVVDLVIPIFSHLIGLL

SEQ ID NO: 233 - protein, 542 aa, Streptococcus agalactiae
VTKYLKYISFVALFLASIFLVACQNQNSQTKERTRKQRPKDELVVSMGAKLPHEFDPKDRYGIHNEGNITHSTLLKRSPELDIKGELAKKYKISKDGLTWSFDLNDDFKFSNGEPVTADDVKFTYDMLKADGKAWDLTFIKNVEVVGKNQVNIHLTEAHSTFTAQLTEIPIVPKKHYNDKYKSNPIGSGPYMVKEYKAGEQAIFVRNPYWHGKKPYFKKWTWVLLDENTALAALESGDVDMIYATPELASKKVKGTRLLDIASNDVRGLSLPYVKKGVVKNSPDGYPVGNDVTSDPAIRKALTIGLNRQKVLDTVLNGYGKPAYSIIDRTPFWNPKTAIKDNKVAKAKQLLTKAGWKEQADGSRKKGNLKAEFDLYYPTNDQLRANLAVEVAEQAKALGITIKLKASNWDEMATKSHDSALLYAGGRHHAQQFYESHYPSLAGKGWTNITFYNNPTVTKYLDKAMTSPDLDKANKYWKLAQWDGKTGASTLGDLPNVWLVSLNHTYIGDKRINVGKQGVHSHGHDWSLLTNIAEWTWDESAK

SEQ ID NO: 234 - protein, 381 aa, Streptococcus agalactiae
MGQEPIIEYQNINKVYGENVAVEDINLKIYPGDFVCFIGTSGSGKTTLMRMVNHMLKPTNGTLLFKGKDISTINPIELRRRIGYVIQNIGLMPHMTIYENIVLVPKLLKWSEEAKRAKARELIKLVELPEEYLDRYPSELSGGQQQRIGVIRALAADQDIILMDEPFGALDPITREGIQDLVKSLQEEMGKTIILVTHDMDEALKLATKIIVMDNGKMVQEGTPNDLLHHPATSFVEQMIGEERLLHAQADITPVKQIMLNNPVSITAEKTLTEAITLMRQKRVDSLLVTDNGKLIGFIDLESLSSKYKKDRLVSDILKHTDFYVMEDDLLRNTAERILKRGLKYAPVVDHENNLKGIVTRASLVDMLYDIIWGDTETEDQ

SEQ ID NO: 235 - protein, 235 aa, Streptococcus agalactiae
MKIDKKEFLALIASIILLIFASVTFFLFKDHGTTQMDTVESSVNHVSDSQLTEAQDMLDKFEKKPSEKLLKDVELALNKLSNSSKKEALQKRFKKAKDKYLKDEADKKATKDATDLVEILEQAPSEENVLKAEAAVNKLTVKESKEALQKRIDTVKTQYGLIGNQTPSSSVAETTEQGTANPASQDTSSYVNQNVAPTYEQPQTNNTPVTPGVNNTVPTPGTGTAPATNGTGVAQ

SEQ ID NO: 236 - protein, 679 aa, Streptococcus agalactiae
MTKDLLLELGLEELPAYVVTPSEKQLGQKMVKFLEDHRLSFETVQTFSTPRRLAVRVKGLADQQTDLTEDFKGPSKKIALDAEGNFSKAAQGFVRGKGLSVDDIEFREVKGEEYVYVTKHETGKSAIDVLASVTEVLTELTFPVNMHWANNSFEYIRPVHTLVVLLDDQALELDFLDIHSGRISRGHRFLGSDTEILSASSYEDDLRQQFVIADAKERQQMIVDQIHAIEEKENISVEIDEDLLNEVLNLVEYPTAFLGSFDEKYLDVPEEVLVTSMKNHQRYFVVRDRDGKLLPNFISVRNGNAEHIENVIKGNEKVLVARLEDGEFFWQEDQKLNIADLVEKLKQVTFHEKIGSLYEHMDRVKVISQYLAEKADLSDEEKLAVLRAASIYKFDLLTGMVDEFDELQGIMGEKYALLAGEQPAVAAAIREHYMPTSADGELPETRVGAILALADKFDTLLSFFSVGLIPSGSNDPYALRRATQGIVRILEAFGWDIPLDELVTNLYGLSFASLDYANQKEVMAFISARIEKMIGSKVPKDIREAVLESDTYIVSLILEASQALVQKSKDAQYKVSIESLSRAFNLAEKVTHSVSVDYSLFENNQEKALYQAILSLELTEDMHDNLDKLFALSPIINDFFDNTMVMTDDEKMKQNRLALLNSLVAKARTVAAFNLLNTK

SEQ ID NO: 237 - protein, 661 aa, Streptococcus agalactiae
MTFDTIDQLAVNTVRTLSIDAIQAANSGHPGLPMGAAPMAYVLWNKFLNVNPKTSRNWTNRDRFVLSAGHGSALLYSLLHLAGYDLSIDDLKQFRQWGSKTPGHPEVNHTDGVEATTGPLGQGIANAVGMAMAEAHLAAKFNKPGFDLVDHYTYTLHGDGCLMEGVSQEAASLAGHLKLGKLVLLYDSNDISLDGPTSQSFTEDVKGRFESYGWQHILVKDGNDLEAIAAAIEAAKAETDKPTIIEVKTIIGFGAEKQGTSSVHGAPLGAEGITFAKKAYGWEYPDFTVPAEVVARFASDLQARGAKAEEAWNDLFAKYEVEYPELAAEYKEAFAGQAETVELKAHDLGSSVASRVSSQQAIQQLSTQLPNLWGGSADLSASNNTMVAAETDFQASNYAGRNIWFGVREFAMAAAMNGIALHGGTRVYGGTFFVFSNYLLPAVRMAALQNLPTVYVMTHDSIAVGEDGPTHEPIEQLASVRSMPNLNVIRPADGNETNAAWQRAVSETDRPTMLVLTRQNLPVLEGTSELAQEGVNKGAYILSEAKGELDGIIIATGSEVKLALDTQDKLESEGIHVRVVSMPAQNIFDEQEASYQEQVLPSAVTKRLAIEAGSSFGWGKYVGLNGLTLTIDTWGASAPGNRIFEEYGFTVENAVSLYKEL

SEQ ID NO: 238 - protein, 273 aa, Streptococcus agalactiae
MTLQDQIIKELGVKPVINPSQEIRRSVEFLKDYLLKHSFLKTYVLGISGGQDSTLAGRLAQLAVEELRADTGENYQFIAIRLPYGIQADEEDAQKALDFIKPDIALTINIKEAVDGQVRALNAAGVEITDFNKGNIKARQRMISQYAVAGQYAGAVIGTDHAAENITGFFTKFGDGGADLLPLFRLNKSQGKQLLAELGADKALYEKIPTADLEENKPGIADEIALGVTYQEIDAYLEGKVVSDKSRGIIENWWYKGQHKRHLPITIFDDFWK

SEQ ID NO: 239 - protein, 745 aa, Streptococcus agalactiae
IKKESVIKLLKYAFGIIMGFIILAIVIGGLLFAYYVSRSPKLTDQALKSVNSSLVYDGNNKLIADLGSEKRESVSADSIPLNLVNAITSIEDKRFFKHRGVDIYRILGAAWHNLVSSNTQGGSTLDQQLIKLAYFSTNKSDQTLKRKSQEVWLALQMERKYTKEEILTFYINKVYMGNGNYGMRTTAKSYFGKDLKELSIAQLALLAGIPQAPTQYDPYKNPESAQTRRNTVLQQMYQDKNISKKEYDQAVATPVTDGLKELKQKSTYPKYMDNYLKQVISEVKQKTGKDIFTAGLKVYTNINTDAQKQLYDIYNSDTYIAYPNNELQIASTIMDATNGKVIAQLGGRHQNENISFGTNQSVLTDRDWGSTMKPISAYAPAIDSGVYNSTGQSLNDSVYYWPGTSTQLYDWDRQYMGWMSMQTAIQQSRNVPAVRALEAAGLDEAKSFLEKLGIYYPEMNYSNAISSNNSSSDAKYGASSEKMAAAYSAFANGGTYYKPQYVNKIEFSDGTNDTYAASGSRAMKETTAYMMTDMLKTVLTFGTGTKAAIPGVAQAGKTGTSNYTEDELAKIEATTGIYNSAVGTMAPDENFVGYTSKYTMAIWTGYKNRLTPLYGSQLDIATEVYRAMMSYLTGGYSADWTMPEGLYRSGSYLYINGTTTTGTYSSSVYKNIYQNSGQSSQSSSSTSSEKQKEDKNTANDANSSSPQVETPNNGNATTPNNSNQTVPGTGHGNGNGNNNTVPNGN

SEQ ID NO: 240 - protein, 425 aa, Streptococcus agalactiae
MLDLKRIRTDFDVVAKKLATRGVDQETLTTLKELDIKRRELLIKAEEAKAQRNVASAAIAQAKRNKENADEQIAAMQTLSADIKAIDAELADVDANLQSMVTVLPNTPADDVPLGADEDENVEVRRWGTPREFDFETKAHWDLGESLGILDWERGAKVTGSRFLFYKGLGARLERAIYSFMLDEHAKEGYTEVIPPYMVNHDSMFGTGQYPKFKEDTFELADSPFVLIPTAEVPLTNYYRDEIIDGKELPIYFTAMSPSFRSEAGSAGRDTRGLIRLHQFHKVEMVKFAKPEESYQELEKMTANAENILQKLNLPYRVITLCTGDMGFSAAKTYDLEVWIPAQNTYREISSCSNTEDFQARRAQIRYRDEVDGKVRLLHTLNGSGLAVGRTVAAILENYQNEDGSVTIPEVLRPYMGNIDIIKPN

SEQ ID NO: 241 - protein, 266 aa, Streptococcus agalactiae
VTISNQELTLTPLRGKSGKAYIGTYPNGERVFVKYNTTPILPALAKEQIAPQLLWARRTSNGDMMSAQEWLDGRTLTKEDMGSKQIIHILLRLHKSRPLVNQLLQLGYKIENPYDLLMDWEKQTPIQIRENTYLQSIVTELKRSLPEFRTEVATIVHGDIKHSNWVITTSGLIYLVDWDSVRLTDRMYDVAYILSHYIPQKHWKDWLSYYGYKDNEKVWSKIIWYGQFSYLSQIIKCFDKRDMEHVNQEIYELRKFRELIKKHNAS

SEQ ID NO: 242 - protein, 521 aa, Streptococcus agalactiae
MKISQYNKWSIRRLKVGAASVMIASGSIVALGQSHIVSADEMSQPKTTITAPTANTSTNVESSTDKALSKVTTMETSSEMPKMQNMAKVEKTSDKPMMVATSVRKMMATPTPVAMTKTTSVDEVKKSTDTAFKQTVDVPAHYVNAAKGNGPFLAGVNQTIPYEAFGGDGMLTRLILKSSEGAKWSDNGVDKNSPLLPLKGLTKGKYFYQVSLNGNTTGKEGQALLDQIKANDKHSYQATIRVYGAKDGKVDLKNMISQKMVTINIPHITTDMEVKNSLKMAFKEKVDVPAKYVSAAKAKGPFLAGVNETIPYEAFGGDGMLTRLILKASEGAKWSDNGVDKNSPLLPLKDLTKGKYFYQVSLNGNTAGKKGQALLDQIKANGSHTYQATITIYGTKDGKVDMNTILGQKTVMIHINVAKKDMNSTSMMMKKDKMTMPMKKEMTSSKINTGMMMSNNKMSANMQMSSQAKSNDKAGKKMSMMSKNLPNTGETKQQNVGVLGMLSLAFATGLTALGLKKSKQR

SEQ ID NO: 243 - protein, 449 aa, Streptococcus agalactiae
MTHITFDYSKVLGQFVGEHELDYLQPQVSAADAFLRQGTGPGSDFLGWMDLPENYDKEEFSRIQKAAEKIKSDSEVLVVIGIGGSYLGAKAAIDFLNNHFANLQTAEERKAPQILYAGNSISSTYLADLVEYVQDKEFSVNVISKSGTTTEPAIAFRVFKELLVKKYGQEEANKRIYATTDKVKGAVKVEADANNWETFVVPDNVGGRFSVLTAVGLLPIAASGADITALMEGANAARKDLSSDKISENIAYQYAAVRNVLYRKGYITEILANYEPSLQYFGEWWKQLAGESEGKDQKGIYPTSANFSTDLHSLGQFIQEGYRNLFETVVRVEKPRKNVTIPELTEDLDGLGYLQGKDVDFVNKKATDGVLLAHTDGGVPNMFVTLPTQDAYTLGYTIYFFELAIGLSGYLNSVNPFDQPGVEAYKRNMFALLGKPGFEELSAELNARL

SEQ ID NO: 244 - protein, 105 aa, Streptococcus agalactiae
MKEKQTAGRRQLEEFAPEFARYNDDILFGEVWAKEDHLTDKTRSIITISALISGGNLEQLEHHLQFAKQNGVTKEEIADIITHLAFYVGWPKAWSAFNKAKEIWI

SEQ ID NO: 245 - protein, 156 aa, Streptococcus agalactiae
AWRALEDAQKSGKVKSIGVSNFLEKDLENILKNGHVKPAVNQILAHIGNTPFDLIDYCQSKGIQVEAYSPIAHGQALKSDGIQKMAEKYGVSVAQLCIQYLLQLNLIVLPKASSKEHLQSNLDFDFVISDEDMSILKSLMFDDYGEFSNFPVFSEK

SEQ ID NO: 246 - protein, 1126 aa, Streptococcus agalactiae
MFRRSKNNSYDTSQTKQRFSIKKFKFGAASVLIGLSFLGGVTQGNLNIFEESIVAASTIPGSAATLNTSITKNIQNGNAYIDLYDVKNGLIDPQNLIVLNPSSYSANYYIKQGAKYYSNPSEITTTGSATITFNILDETGNPHKKADGQIDIVSVNLTIYDSTALRNRIDEVINNANDPKWSDGSRDEVLTGLEKIKKDIDNNPKTQIDIDNKINEVNEIEKLLVVSLPDKIKYSPEAKHRTVEQHAELDAKDSIANTDELPSNSTYNWKNGHKPDTSTSGEKDGIVEVHYPDGTVDDVNVKVTVTSKKTDNTAPTLTVTPEQQTVKVDEDITFTVTAEDENEVELGLDDLKAKYENDIIGARVKIKYLTKEPNKKVMEVTIMKATLADKGAITFTAKDKAGNQAEPKTVTINVLPPDKIKYSPEAKHRTVEQHAELDAKDSIANTDELPSNSTYNWKNGHKPDTSTSGEKDGIVEVHYPDGTVDDVNVKVTVTSKKTDNTAPTLTVTPEQQTVKVDEDITFTVTAEDENEVELGLDDLKAKYENDIIGARVKIKYLTKEPNKKVMEVTIMKATLADKGAITFTAKDKAGNQAEPKTVTINVLPPDKIKYSPEAKHRTVEQHAELDAKDSIANTDELPSNSTYNWKNGHKPDTSTPGEKNAVVVVTYPDKSTDEVPVKVTVVDPRTDAEKNDPAGKDQTVKVGEQPDPTKSLEAVPAGSTVAYKEPVDTKTPGEKNAIVVVTYPDKSTDEVPVKVTVVDPRTDAEKNDPAGKDQTVKVGEQPDPTKSLEAVPAGSTVAYKEPVDTKTPGEKNAIVVVTYPDKSTDEVPVKVTVVDPRTDAEKNDPAGKDQTVKVGEQPDPTKSLEAVPAGSTVAYKEPVDTKTPGEKNAVVVVTYPDKSTDEVPVKVTVVDPRTDAEKNDPAGKDQTVKVGEQPDPTKSLEAVPAGSTVAYKEPVDTKTPGEKNAVVVVTYPDKSTDEVPVKVTVVDPRTDAEKNDPAGGETTVPQGTPISDEEITGLVKIPEGSNGVPKVVGDRPNTDVPGDYKVTVEVTYPDGTKDTVAVTVHVTPKPVPDKDKYDPTGKSQQVNGKGNKLPATGESATPFFNVAALTIISSVGLLSVSKKKED

SEQ ID NO: 247 - protein, 189 aa, Streptococcus agalactiae
MQILEDYDGRALPKLETDRLILRQRTVGDVPAMFDYVCLEEVAYPAGLSPIASLEDEYDYFENRYYQNLEKAKLPSGYGITVKGSDRIIGSCAFNHRREDDVFEIGYLLHPDYWGHGYMTEAVAALIEVGFTLLNLHKIEIRCYDYNKQSQRVAEKLGFTLEATIRDRKDNQGNRCVNLIYGLLRSEWE

SEQ ID NO: 248 - protein, 884 aa, Streptococcus agalactiae
MSKELSPKYNPAEVEEGRYQTWLDQDVFKPSGDTEAKPYSIVIPPPNVTGKLHLGHAWDTTLQDIIIRQKRMQGFDTLWLPGMDHAGIATQAKVEERLREQGISRYDLGREKFLDKVWEWKDEYAATIKSQWGKMGLSVDYSRERFTLDEGLSKAVRKVFVDLYNKGWIYRGEFIINWDPAARTALSDIEVIHKDVEGAFYHMNYMLEDGSRALEVATTRPETMFGDVAVAVNPEDPRYKDLIGQNVILPIINKPIPIIADEHADPEFGTGVVKITPAHDPNDFAVGQRHNLPQVNVMNDDGTMNELADEFNGMDRFEARKAVVAKLESLGNLVKIEKMTHSVGHSERTGVVVEPRLSTQWFVKMDQLAKNAIANQDTEDKVEFYPPRFNDTFMSWMENVHDWVISRQLWWGHQIPAWYNVNGEMYVGEDAPEGDGWTQDEDVLDTWFSSALWPFSTMGWPDTEAADFKRYFPTSTLVTGYDIIFFWVSRMIFQSLEFTGRQPFSNVLIHGLIRDEEGRKMSKSLGNGIDPMDVIEKYGADALRWFLSNGSAPGQDVRFSYEKMDASWNFINKIWNISRYILMNNEGLTLDQARENVEKVVNSQVGNVTDRWILHNLNETVGKVTESFDKFEFGVAGHILYNFIWEEFANWYVELTKEVLYSDNEDEKVVTRSVLLYTLDQILRLLHPIMPFVTEEIFGQYAEGSIVLASYPQVNATFENQTAHKGVESLKDLIRSVRNSRAEVNVAPSKPITILVKTSDSELESFFKDNSNYIKRFTNPETLEISSAITAPELAMTSIITGAEIFLPLADLLNVEEELARLEKELAKWQKELNMVGKKLSNERFVANAKPEVVQKEKDKQTDYQTKYDATIARIEEMKKLNND

SEQ ID NO: 249 - protein, 244 aa, Streptococcus agalactiae
MVEPIISIQGLHKSFGKNEVLKGIDLDIHQGEVVVIIGPSGSGKSTFLRTMNLLEVPTKGTVTFEGIDITDKKNDIFKMREKMGMVFQQFNLFPNMTVLENITLSPIKTKGLSKLDAQTKAYELLEKVGLKEKANAYPASLSGGQQQRIAIARGLAMNPDVLLFDEPTSALDPEMVGEVLTVMQDLAKSGMTMVIVTHEMGFAREVADRVIFMDAGIIVEQGTPKEVFEQTKEIRTRDFLSKVL

SEQ ID NO: 250 - protein, 564 aa, Streptococcus agalactiae
MNYKEIYQEWLENDSLGKDIKSDLEAIKGDESEIQDRFYKTLEFGTAGLRGKLGAGTNRMNTYMVGKAAQALANTIIDHGPEAIARGIAVSYDVRYQSKEFAELTCSIMAANGIKSYIYKGIRPTPMCSYAIRALGCVSGVMVTASHNPQAYNGYKAYWKEGSQILDDIADQIANHMDAITDYQQIRQIPFEEALASGLASYIDESIEEAYKKEVLGLTINDTNIDKSVRVVYTPLNGVGNLPVREVLRRRGFENVYVVPEQEMPDPDFTTVGYPNPEVPKAFAYSESLGKSVDADILLATDPDCDRVALEVKDSKGEYIFLNGNKIGALLSYYIFSQRCALGNLPHHPVLVKSIVTGDLSKVIADKYNIETVETLTGFKNICGKANEYDISKDKTYLFGYEESIGFCYGTFVRDKDAVSASMMVVEMTAYYKERGQTLLDVLQTIYDEFGYYNERQFSLELEGAEGQERISRIMEDFRQDPILQVGEMRLENSIDFKDGYKDFPKQNCLKYYFNEGSWYALRPSGTEPKIKCYLYTIGCTEADSLSKLNAIESACRAKMNSTK

SEQ ID NO: 251 - protein, 403 aa, Streptococcus agalactiae
MYREITAVEHDRFVSESNQTNLLQSSNWPKVKDNWGSQLLGFFDGETQIASASILIKSLPLGFSMLYIPRGPIMDYSNLDIVTKVLKDLKAFGKKQRALFIKCDPLIYLKMVNAKDFENSPDEKEGLIAIDHLQRAGADWTGRTTDLAHTIQPRFQANLYANQFGLDKMSKKTRQAIRTSKNKGVDIQFGSHELLEDFAELMKKTEDRKGINLRGIDYYQKLLDTYPNNSYITMASLDVAKRLEKIEKECQIAQSERIKSLELNREKKVKQHQGTIDRLNKEIDFLKEAQKAYDRDIIPLAATLTLEFGNTSENIYAGMDDYFKSYSAPIYTWFETAQRAFERGNIWQNMGGIENDLSGGLYHFKSKFEPIIEEFIGEFNIPVNRLLYKASNYVYALRKKRNS

SEQ ID NO: 252 - protein, 465 aa, Streptococcus agalactiae
MACTTILVGKKASYDGSTMIARTEDSVNGDFTPKKLKVMTSKDQPRHYKSVLSNFEVDLPDNPLPYTSVPDALGKDGIWGEAGINSKNVAMSATETITTNSRVLGADPLVSDGIGEEDILTLVLPYIQSAREGVERLGAILEKYGTYESNGIAFSDTEEIWWLETIGGHHWIARRVPDDVYVTNPNQLGIDHFEFNNCDDYMCSSDLKEFIEQYHLDLTYSNEHFNPRYAFGSQRDKDRHYNTPRSWAMQRFLNPEIEQDPRSLFIPWCQKPYRKITVEDIKYVLSDHYQDSVYDPYGPEGDAVSRRAFRSVGINRTSQTSILQLRPNKSLETTGVQWLSYGSMPFATMVPLFTQVETVPNYFSNTTKDASTDNFYWTNRLIAALADPHFYQHEADIESYIERTMAQGHAHINGVDREVAENKEIDFQQKNQEMSDYIQKESQELLNRILFDASNLMTNRFSMGD

SEQ ID NO: 253 - protein, 506 aa, Streptococcus agalactiae
MRKKFLLLMSFVAMFAAWQLVQVKQVWADSKLKVVTTFYPVYEFTKNVVGDKADVSMLIKAGTEPHDFEPSTKNIAAIQDSNAFVYMDDNMETWAPKVAKSVKSKKVTTIKGTGDMLLTKGVEEEGEEHEGHGHEGHHHELDPHVWLSPERAISVVENIRNKFVKAYPKDAASFNKNADAYIAKLKELDKEYKNGLSNAKQKSFVTQHAAFGYMALDYGLNQVPIAGLTPDAEPSSKRLGELAKYIKKYNINYIYFEENASNKVAKTLADEVGVKTAVLSPLEGLSKKEMAAGEDYFSVMRRNLKVLKKTTDVAGKEVAPEEDKTKTVETGYFKTKDVKDRKLTDYSGNWQSVYPLLQDGTLDPVWDYKAKSKKDMTAAEYKKYYTAGYKTDVESIKIDGKKHQMTFVRNGKSQTFTYKYAGYKILTYKKGNRGVRYLFEAKEKDAGQFKYIQFSDHGIKPNKAEHFHIFWGSESQEKLFEEMENWPTYFPAKMSGREVAQDLMSH

SEQ ID NO: 254 - protein, 554 aa, Streptococcus agalactiae
MKLSKKLLFSAAVLTMVAGSTVEPVAQFATGMSIVRAAEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPSIPNTGGIGTAIFVAIGAAVMAFAVKGMKRRTKDN

SEQ ID NO: 255 - protein, 890 aa, Streptococcus agalactiae
MKKRQKIWRGLSVTLLILSQIPFGILVQGETQDTNQALGKVIVKKTGDNATPLGKATFVLKNDNDKSETSHETVEGSGEATFENIKPGDYTLREETAPIGYKKTDKTWKVKVADNGATIIEGMDADKAEKRKEVLNAQYPKSAIYEDTKENYPLVNVEGSKVGEQYKALNPINGKDGRREIAEGWLSKKITGVNDLDKNKYKIELTVEGKTTVETKELNQPLDVVVLLDNSNSMNNERANNSQRALKAGEAVEKLIDKITSNKDNRVALVTYASTIFDGTEATVSKGVADQNGKALNDSVSWDYHKTTFTATTHNYSYLNLTNDANEVNILKSRIPKEAEHINGDRTLYQFGATFTQKALMKANEILETQSSNARKKLIFHVTDGVPTMSYAINFNPYISTSYQNQFNSFLNKIPDRSGILQEDFIINGDDYQIVKGDGESFKLFSDRKVPVTGGTTQAAYRVPQNQLSVMSNEGYAINSGYIYLYWRDYNWVYPFDPKTKKVSATKQIKTHGEPTTLYFNGNIRPKGYDIFTVGIGVNGDPGATPLEAEKFMQSISSKTENYTNVDDTNKIYDELNKYFKTIVEEKHSIVDGNVTDPMGEMIEFQLKNGQSFTHDDYVLVGNDGSQLKNGVALGGPNSDGGILKDVTVTYDKTSQTIKINHLNLGSGQKVVLTYDVRLKDNYISNKFYNTNNRTTLSPKSEKEPNTIRDFPIPKIRDVREFPVLTISNQKKMGEVEFIKVNKDKHSESLLGAKFQLQIEKDFSGYKQFVPEGSDVTTKNDGKIYFKALQDGNYKLYEISSPDGYIEVKTKPVVTFTIQNGEVTNLKADPNANKNQIGYLEGNGKHLITNTPKRPPGVFPKTGGIGTIVYILVGSTFMILTICSFRRKQL

SEQ ID NO: 256 - protein, 201 aa, Streptococcus agalactiae
GAKKAGWTEYARMLEVREQVDHVMIPKINQDLPIYAGPEEDNLQRGVGHLEGISLPIGGASTHAVLSGQRGMPAARLFADLDKMKKGDYFYVTNLKETLAYQVDRIMVIEPSQLDAVSIEEDKDYVTLLTCTPYMGSLSTVMGDLSLTTRENQLGSLSFWMFKAMRILLLKFLKLRKPKACRLMSLISLLVASNLALERDS

SEQ ID NO: 257 - protein, 352 aa, Streptococcus agalactiae
MSDVVEKQTAKSFIMNVLNGLALGTVIVLIPGAILGELMKALLPMWSGFATLIAATAVATSMMGLVIGIMVGLNFKFNPIQSASLGLAVMFAGGAATFLKGAIMLKGTGDIINMGITAALGVLLIQFLSDKTKSFTLIVIPTVTLLLVGGVGHVLLPYVKMITTMIGQGIASLLGLQPVLMSILIAMIFCFLIVSPITTVGIALAISLSGIGSGAANLGICAASFGLCMAGWSVNSKGTALAHVLGSPKISMANVLAKPKIMLPMISSAAILGILGALFNIQGTPASAGFGISGLIGPINALNLAKGGWSVMNMLLIIIIFVAAPIILNFIFNYLFIKVLKIIDPMDYKLDI

SEQ ID NO: 258 - protein, 223 aa, Streptococcus agalactiae
MARPLVEQTADRLLHLILEREYPVGAKLPNEYELAEDLDVGRSTIREAVRSLATRNILEVRQGSGTYISSKKGVSEDPLGFSLIKDTDRLTSDLFELRLLLEPRIAELVAYRITDDQLQLLEKLVGDIEDAVHAGDPKHLLLDVEFHSMLAKYSGNIAMDSLLPVINQSIHLINANYTNRQMKSDSLEAHREIIKAIREKNPVAAHDAMLMHIMSVRRSALKA

SEQ ID NO: 259 - protein, 188 aa, Streptococcus agalactiae
MIKKNKVFLGVLLVLVVILGGGVLFYQSQFQKTTNQALAIAYKDAKVAKKDVIHQKIDKEFENFRGSYEIEFNTKSAEYSYHVDAKTGQILERDMDNNGFSKSTSQSSSSSSQKSHKISQEEAKKIAFKDANIEESEVSNLKIKEEIENGKSVYDIDFVDLKNKNEVDYQIDAETGKIIERSRDHMND

SEQ ID NO: 260 - protein, 680 aa, Streptococcus agalactiae
LNRKKRYRLTVKKQNASIPRRLNLLFFIIVLLFTVLILRLEQMQIGQQSFYMKKLTALTSYTVKESKARGQIFDAKGVVLVENDERPTVAFSRGNNISSQSIKELANKLSHYITLTEVASSDRAKRDYYLADKANYKKVVESLPDSKRYDKFGNHLAESTVYANAVAAVPVSAINYSEDELKVVALFNQMNATPTFGSVKLSTGELSDDQIKKLDADKKELLGISVTSNWHRRKKGTSLSDILGTISTEKAGLPREEVKKYLKKGYSLNDRVGTSYLEKQYEDDLQGIRQIRKVVVNKKGKVVSDNITQEGKSGRNLKLTIDLNYQNKVESILKQYYGSELSSGRASFSEGMYAVAIEPSTGKVLAMAGLKNDHGNLVDDSLGTIAKNFTPGSVVKGATLSSGWENKVLRGNEVLYDQEIANIRSWFTRGLTPISAAQALEYSSNTYMVQVALRLMGQDYNTGDALTDRGYQEAMAKLRKTYGEYGLGVSTGLDLPESEGYVPGKYSLGTTLMESFGQYDAYTPMQLGQYISTIANNGNRLAPHVVSDIYEGNDSNKFAQLVRSITPKTLNKIAISDQELAIIQEGFYNVVNSGSGYATGTSMRGNVTTISGKTGTAETFAKNVNGQTVSTYNLNAIAYDTNRKIAVAVMYPHVTTDTTKSHQLVARDMIDQYISQFTGQ

SEQ ID NO: 261 - protein, 475 aa, Streptococcus agalactiae
MTVFPKHFLWGGAVAANQVEGAFRTDGKGLSVQDVLPNGGLGDFTAKPTPDNLKLEAIDFYHNYKNDIKLFAEMGFKVFRTSIAWSRIFPNGDDSAPNEAGLQFYDNLFDELLKYNIEPLVTLSHYETPLHLAKTYNGWADRRLIAFFEKFAQTVMERYKDKVKYWLTFNEVNSILHMPFTSGAIMTDKSQLSPQELYQAIHHELVASARVTKLGRSINPNFKIGCMILAMPAYPMTSDPRDVLAARQFEQHNLLFSDIHVRGKYPTYIQSYFKNNGIKIKFEEGDEEVLAQNTVDFLSFSYYMSVTQAYDFENYQSGQGNILGGLTNPHLTTSEWGWQIDPIGLRLVLNQYYERYQIPLFIVENGLGAKDQLIETLDGDYTVEDDYRIDYMNQHLVQVAKAIEDGVEIMGYTSWGCIDCVSMSTAQLSKRYGLIYVDRNDDGTGSLQRYKKKSFGWYQKVIKTNGQSLFEHHNR

SEQ ID NO: 262 - protein, 161 aa, Streptococcus agalactiae
MATFQIKEKMFSLGGKFTITDQTGLPCYHVEGSLFPLPKTFKVFDEEGHLISQIEKKVLSFLPKFNVTLANGNHFTIKKDFSFLKPHYTIEDLDMEVKGNFWDIDFQLLKDNQVIANISQQWFRMTSTYQVEVYNETYNDLTISLVIAIDYVKELEKNASN

SEQ ID NO: 263 - protein, 181 aa, Streptococcus agalactiae
MKKITTLILASSLLLVATTSVKADDNFEMPTRYVKMSEKSKAFYQRLQEKQRKAHTTVKTFNNSEIRHQLPLKQEKARNDIYNLGILISQESKGFIQRIDNAYSLENVSDIVNEAQALYKRNYDLFEKIKSTRDKVQVLLASHQDNTDLKNFYAELDDMYEHVYLNESRVEAINRNIQKYN

SEQ ID NO: 264 - protein, 306 aa, Streptococcus agalactiae
MKLKKFFEDLLAKLEYRPIQVFMRHFQSAEMDLSAIAVAYYLLVTAFPLLVIAANIFPYFHINVSDLLSLMQKNLPKNIYEPASRLAVDAFSKPSTGILGFASLTAFWTMSKSLTSLQKAINKAYGVDQHRDFVISRLVGVGTGLIILFLLTFVLIFSTFSKPVLQIIVNMYDLGDTLTAWLLNLAQPVTFLTIFLGIGILYFILPNARIRKVRYVIPGTLFSTFVIGFFSNLISQYVLNRVEKMVDIKTFGSVVIFILMLWFIFLAHIMILGAILNASVQEIATGKIESRRGDIMSLIQKSKEEK

SEQ ID NO: 265 - protein, 1077 aa, Streptococcus agalactiae
MKLLYTDINHDMTEILVNQAAHAAEAGWRIFYIAPNSLSFEKERAVLENLPQEASFAITITRFAQLARYFTLNQPNQKESLNDIGLAMIFYRALASFEDGQLKVFGRLKQDASFISQLVDLYKELQTANLSILDLKYLHSPEKFEDLLAIFLVVSDLLREGEYDNQSKIAFFTEQVRSGQLDVDLKNTILIVDGFTRFSAEEEALIKSLSSRCQEIIIGAYASQKAYKANFTNGNIYSAGVDFLRYLATTFQTKPEFILSKWESKSGFEMISKNIEGKHDFTNSSHILDDTAKDCITIWECINQKDEVEHVARAIRQKLYQGYRYKDILVLLGDVDSYKLQLSKIFEQYDIPYYFGKAETMAAHPLVHFMDSLSRIKRYRFRAEDVLNLFKTGIYGEISQDDLDYFEAYISYADIKGPKKFFTDFVVGAKKFDLGRLNTIRQSLLAPLESFVKTKKQDGIKTLNQFMFFLTQVGLSDNLSRLVGQMSENEQEKHQEVWKTFTDILEQFQTIFGQEKLNLDEFLSLLNSGMMQAEYRMVPATVDVVTVKSYDLVEPHSNQFVYALGMTQSHFPKIAQNKSLISDIERQLINDANDTDGHFDIMTRENLKKNHFAALSLFNAAKQALVLTIPQLLNESEDQMSPYLIELRDIGVPFNHKGRQSLKEEADNIGNYKALLSRVVDLYRSAIDKEMTKEEQTFWSVAVRYLRRQLTSKGIEIPIITDSLDTVTVSSDVMTRRFPEDDPLKLSSSALTTFYNNQYKYFLQYVLGLEEQDSIHPDMRHHGTYLHRVFEILMKNQGIESFEEKLNSAINKTNQEDVFKSLYSEDAESRYSLEILEDIARATATILRQDSQMTVESEEERFELMIDNTIKINGIIDRIDRLSDGSLGVVDYKSSAQKFDIQKFYNGLSPQLVTYIDAISRDKEVEQKPPIFGAMYLHMQEPKQDLSKIKNLDDLVTKNHQALTYKGLFSEAEKEFLANGKYHLKDSLYSEAEIAILQAHNQLLYKKASETIKSGKFLINPYTEDAKTVDGDQFKSITGFEADRHMARARALYKLPAKEKRQGFLTLMQQEEENDDL

SEQ ID NO: 266 - protein, 332 aa, Streptococcus agalactiae
MSETKVMALREAINVAMSEEMRKDEKVFLMGEDVGVYGGDFGTSVGMLEEFGAKRVRDTPISEAAIAGSAIGAAQTGLRPIVDLTFMDFVTIAMDAIVNQGAKTNYMFGGGLSTPVTFRVASGSGIGSAAQHSQSLEAWLTHIPGLKVVAPGTVNESKALLKSSILDNNPVIFLEPKALYGKKEEVNMDPDFYIPLGKGDIKREGTDLTIVSYGRMLERVMQAAEEVAEEGINVEVVDPRTLIPLDKELIIDSVKKTGKLILVNDAYKTGGFTGEIATMVAESEAFDYLDHPIVRLASEDVPVPYSRVLEQGILPDVAKIKDAIYKVVNKGK

SEQ ID NO: 267 - protein, 585 aa, Streptococcus agalactiae
MAFDVIMPKLGVDMQEGEILEWKKNEGDTVNEGDVLLEIMSDKTNMEIEAEDTGVLLKIVHQAGDVVPVTEVIAYIGEEGEEVGTSSPSADATITAEDGQSVSGPAAPSQETVAAATPKEELAADEYDIVVVGGGPAGYYAAIRGAQLGGKIAIVEKTEFGGTCLNVGCIPTKTYLKNAEILDGLKVAAGRGINLASTNYAIDMDKTVAFKNSVVKTLTGGVRGLLKANKVEIFNGLGQVNPDKSVVIGDKVIKGRNVVLATGSKVSRINIPGIESPLVLTSDDILDLREIPKSLAVMGGGVVGIELGLVWASYGVDVTVIEMADRIIPAMDKEVSLELQKILAKKGMKIKTSVGVSEIVEANNQLTLKLNNGEEVVADKALLSIGRVPQMNGLENLEPELEMERGRIKVNAYQETSIPGIYAPGDVNGTRMLAHAAYRMGEVAAENALGGNKRKAHLDFTPAAVYTHPEVAMVGMTEEQAREQYGDILVGKNSFTGNGRAIASNEAHGFVKVIAEPKYKEILGVHIIGPAAAELINEASTIMENELTVYDVAQSIHGHPTFSEVMYEAFLDVLGEAIHNPPKRK

SEQ ID NO: 268 - protein, 450 aa, Streptococcus agalactiae
MGKYFGTDGVRGEANVELTPELAFKLGRFGGYVLSQHETDRPRVFVARDTRISGEMLESALIAGLLSVGIEVYKLGVLATPGVSYLVRTEKASAGVMISASHNPALDNGIKFFGSDGFKLDDDRELEIEALLDAKEDTLPRPSAQGLGTLVDYPEGLRKYEKFMESTGIDLEGMKVALDTANGAATASARNIFLDLNADISVIGDQPDGLNINDGVGSTHPEQLQSLVRENGSDIGLAFDGDSDRLIAVDENGEIVDGDKIMFIIGKYLSDKGQLAQNTIVTTVMSNLGFHKALDREGIHKAITAVGDRYVVEEMRKSGYNLGGEQSGHVIIMDYNTTGDGQLTAIQLTKVMKETGKKLSELASEVTIYPQKLVNIRVENNMKDKAMEVPAIAEIIAKMEEEMDGNGRILVRPSGTEPLLRVMAEAPTNEAVDYYVDTIADVVRTEIGLD

SEQ ID NO: 269 - protein, 877 aa, Streptococcus agalactiae
MKGQKIIALAGLVLSCHFALTACHTQEHKNSHHIKTKQVAKKKANKKKVSVKESHKKRKGVAGVDFPTDDGFLLTKDSKILSHPDSGIVVAHGNHSHFIFYSDLKGSKFSYLIPNANAKTNKKQAVRNFKAGAVAVNTLNDGYVFNPADIVSEDANGYVVRHGDHFHYIPKASLSQQKQVQASRAVSRLGNQNNSHYRVNSSKIAGLHHPTSDGFLFNGQGIKGTTPTGILVEHHNHLHFISFADLRKGGWGSIADRYQPQKKVDSKKQSPSSKKPRTENTLPKDIKDKLAYLARELHLDISRIRVLKTLNGEIGFEYPHDDHTHVIMAKDIDLSKPIPNPHHDDEDHHKGHHHDESDHKHEEHEHTKSNKLSDEDQKKLIYLAEKLGLNPNQIEVLTSEDGSIIFKYPHDDHSHTIASKDIEIGKPIPDGHHDHSHAKDKVGMATLKQIGFDDEIIQDILHADAPTPFPSNETNPEKMRQWLATVTKINIGQRTNPFQRFGLSLMPNIEVLGIGFTPINDMTPVLQFKKLKQLWMTNTGITDYSFLDKMPLLEGLDISQNGIKDLSFLTKYKQLSLIAAANNGITSLKPLAELPNLQFLVLSHNNISDLTPLSNLTKLQELHLDHNNVKNLSALSGKKDLKVLDLSNNKSADLSTLKTTSLETLLLNETNTSNLSFLKQNPKVSNLTINNAKLASLDGIEESDEIVKVEAEGNQIKSLVLKNKQGSLKFLNVTNNQLTSLEGVNNYTSLETLSVSKNKLESLDIKTPNKTVTNLDFSHNNVPTSQLKLNEKNIPEAVAKNFPAVVEGSMVGNGSLAEKAAMASKEDKQVSDNTNHQKNTEKSAQANADSKKENPKTHDEHHDHEETDHAHVGHHHH

SEQ ID NO: 270 - protein, 500 aa, Streptococcus agalactiae
MNKRVKIVATLGPAVEFRGGKKFGESGYWGESLDVEASAEKIAQLIKEGANVFRFNFSHGDHAEQGARMATVRKAEEIAGQKVGFLLDTKGPEIRTELFEDGSDFHSYTTGTKLRVATKQGIKSTPEVIALNVAGGLDIFDDVEVGKQILVDDGKLGLTVFAKDKDTREFEVVVENDGLIGKQKGVNIPYTKIPFPALAERDNADIRFGLEQGLNFIAISFVRTAKDVNEVRAICEETGNGHVKLFAKIENQQGIDNIDEIIEAADGIMIARGDMGIEVPFEMVPVYQKMIITKVNAAGKAVITATNMLETMTDKPRATRSEVSDVFNAVIDGTDATMLSGESANGKYPVESVRTMATIDKNAQTLLNEYGRLDSSAFPRNNKTDVIASAVKDATHSMDIKLVVTITETGNTARAISKFRPDADILAVTFDEKVQRSLMINWGVIPVLADKPASTDDMFEVAERVALEAGLVESGDNIVIVAGVPVGTGGTNTMRVRTVK

SEQ ID NO: 271 - protein, 329 aa, Streptococcus agalactiae
MTATKQHKKVILVGDGAVGSSYAFALVNQGIAQELGIIEIPALFDKAVGDAEDLSHALAFTSPKKIYAATYADCADADLVVITAGAPQKPGETRLDLVGKNLAINKSIVTQVVESGFNGIFLVAANPVDVLTYSTWKFSGFPKERVIGSGTSLDSARFRQALADKIGVDARSVHAYIMGEHGDSEFAVWSHANVAGVQLEQWLQENRDIDEQGLVDLFISVRDAAYSIINKKGATYYGIAVALARITKAILDDENAVLPLSVYQEGQYGDVKDVFIGQPAIVGAHGIVRPVNIPLNDAELQKMQASAEQLKDIIDEAWKNPEFQEASKN

SEQ ID NO: 272 - protein, 819 aa, Streptococcus agalactiae
MQDKNLVDVNLTSEMKTSFIDYAMSVIVARALPDVRDGLKPVHRRILYGMNELGVTPDKPHKKSARITGDVMGKYHPHGDSSIYEAMVRMAQWWSYRHMLVDGHGNFGSMDGDGAAAQRYTEARMSKIALEMLRDINKNTVDFQDNYDGSEREPLVLPARFPNLLVNGATGIAVGMATNIPPHNLGESIDAVKLVMDNPDVTTRELMEVIPGPDFPTGALVMGRSGIHRAYETGKGSIVLRSRTEIETTSNGKERIVVTEFPYGVNKTKVHEHIVRLAQEKRIEGITAVRDESSREGVRFVIEVRRDASANVILNNLFKLTSLQTNFSFNMLAIEKGVPKILSLRQIIDNYIEHQKEVIVRRTQFDKAKAEARAHILEGLLVALDHLDEVITIIRNSETDTIAQAELMSRFELSERQSQAILDMRLRRLTGLERDKIQSEYNDLLALIADLADILAKPERVVTIIKEEMDEVKRKYADARRTELMIGEVLSLEDEDLIEEEDVLITLSNKGYIKRLAQDEFRAQKRGGRGIQGTGVNNDDFVRELVSTSTHDTVLFFTNLGRVYRLKAYEIPEYGRTAKGLPIVNLLKLDEGETIQTIINARKEDVANKYFFFTTQQGIVKRTSVSEFSNIRQNGLRAINLKENDELINVLLIDENEDVIIGTRTGYSVRFKVNAVRNMGRTATGVRGVNLREGDKVVGASRIVNGQEVLIITEKGYGKRTEASEYPTKGRGGKGIKTANITAKNGPLARLVTINGNEDIMVITDTGVIIRTNVANISQTGRSTMGVKVMRLDQEAKIVTVALVEQEIEDKSNIEDTKE

SEQ ID NO: 273 - protein, 442 aa, Streptococcus agalactiae
MTIFDERELKERFTHENRVSFYEFVAKYDAQMVPVMKAKGYRCIHSMERTVVFTFGEFTIRRRRWQKGEHWVVPVDEKLGLKKNVRYSLEFMYQIASLATMMPYEKVIKVVQMMYCIVITKPTVVKAVKISRELLKEKEAYRFFDEDIPVDKEPVDMIYLEGDGVMVKAREEGLDNRNVDLSHFVVHTGSQKVGSNRFVLQNKKEFVSLDNRQTRQKILDYLYNHFYIAPNTLLITNSDGGHGYTPYVFKEIAKALKVKQHEHFWDRYHVNEKIKSFFKLYPVELMTGAFQSIKQHDKEKLRTVLDTTEALILMEEEMEGFNQFKRKLLNNFQYTKSAELRGFSRAGIGVMESQHRKITYRMKKRGMYWTIQGAETMSQLIVLSYEGQLRDLFFGSWREDYQKYQELENLSAGKIKHEQNKINKRYDLQTLGRLRYGRHRNL

SEQ ID NO: 274 - protein, 127 aa, Streptococcus agalactiae
MAYLSKLSDLDPSLMDADSEQIYIPKVLFEHNDFKGLTYKEILLYSFLLNRLREPLDFIQKGYDDNEDTYVHFKVEDLCELLNQSKTTVISLKKRLAQYGLIEEVKAGSHQPNRIYLTDKLVPYIKG

SEQ ID NO: 275 - protein, 92 aa, Streptococcus agalactiae
MTDNRFAQLKENFEKGSPKRRVPTSRPIAAQKAPESYNKKGRYPFSLHQDVRYDKLEALVAYHGAKSASDYLERLIVQEWEKMQRKLKNKEK

SEQ ID NO: 276 - protein, 1049 aa, Streptococcus agalactiae
MFSWLEALYYTLIQLAKVNRLNALFLVSVVGYLCYQGIKLVRKTIRNFFQLMKGFIGDRENIKKCIKNKKEALVHSWKHRQDIDWKSTGKDKSKQLWNLMKRLATVAPSFLFLLLGNVLFRLIYQLPFVKQDRKRFDKEMKPLLYFKNYRSFVFMGIGFSFIAFILTNYFVTVLRAAIRFLYFSIMTLRDNSQVVSFNVDSLLIQNLFNARVFVIAPILAVPIFLIGLVVAWRSAWVNFEQYRDYNHNEEGDDRFATVKEIHQQYKKVPNKTETYPGEGGVPVLHETRKNLTGLTLKSQMLWQNRTFSRYLTNAERILGLLSTPSGDYYIDDSTTNLITMGITRSGKGEAHIAPIIDINSRAEIQPSLIIADPKGEHYQSSYKTMRRRGYDVNVLSFQNMDWSMSYNPLALAIAAAKKGYYEMTQTRVNAVAEAIYRKTKPGSGNGNAKYWEDTSISLFNAIAMALMDRANETVRNGETDAWDTVTVRNIAKFLTDLGSEEVFVNDFGEIVENPDKNQQVKKKSKITVYFDNLRKINQEQFSKFRDMADLNFRSSDFASEETKGNVFSSMMSGINLFLQDNIAKLTSKNSIDLESVGFPRRLSIKFRSSSNVAMRNEYTHKTAKVTITSQAVWGKTTKQVIHVDAATALIDGEGYLTYVIEPQLPDQFLVTIDFNHENNGGSAIRHKTFQFSAEKVYKKRGNVITLDDYTKKPVLDHIKVTVLNKQDDNLLQKEDIDLIYSDNPKVIYLVTPPNRTEYNSIVSLFLDQLFNANYELALSNGRKCVNRILHILDEFTNIPAIPHMDTKISIGLGQNILYYLWIQNLKQLVSEYGENTAETIRENCSLKVYIKSTAPATNEYFSKELGTRTITRRRRSSNILDEANPNVSIENPRQELLTPTQLSKLQEGEAVILRGVKGRDNAGRKITTDPIFLHEKTSLPYRYMFLQEEFDQSMALADIPVESGHRDLDLQDIAVGAQSTFNKIIDWRMALTDRMRTNGKIPQLASRKQTIKALSQSQFTSPADLTQAVIAEVFDEEDDDDLFFVDDVM

SEQ ID NO: 277 - protein, 933 aa, Streptococcus agalactiae
MNSNTKGHGFFRKSKAYGLVCAIALAGAFTLATSQVSADQVTTQATTQTVTQNQAETVTSTQLDKAVATAKKAAVAVTTTPAVNHATTTDAQADLANQTQAVKDVTAKAQANTQAIKDATAENAKIDAENKAEAERVAKENKEGQAAVDARNKAGQAAVDARNKAKQQAQDDQKAKIDAENKAESQRVSQLNAQNKAKIDAENKDAQAKANATNAQLQKDYQAKLAEIKSVEAYNAGVRQRNKDAQAKADATNAQLQKDYQAKLALYNQALKAKAEADKQSINNVAFDIKAQAKGVDNAEYGNSIMTAKTKPDGSFEFNHDMIDGVKTIGYGKLTGKVNHHYVANKDGSVTAFVDSVTLYKYEYRNVAQNAAVNQNIVFRVLTKDGRPIFEKAHNGNKTFAETLNKTLQLNLKYELKPHASSGNVEVFKIHDDWVHDTHGSALVSYVNNNDAVPNVVIPERPTPPKPVKVTPEAEKPVPEKPVEPKLVTPTLKTYTPVKFIPREYKPEPITPETFTPEKFTPAQPKVKPHVSIPEKINYSVSVHPVLVPAANPSKAVIDEAGQSVNGKTVLPNATLDYVAKQNFSQYKGIKASAEAIAKGFAFVDQPNEALAELTVKSIKASNGDDVSSLLEMRHVLSKDTLDQKLQSLIKEAGISPVGEFYMWTAKDPQAFYKAYVQKGLDITYNLSFKIKANFTKGQIKNGVAQIDFGNGYTGNIVVNDVTVPEVHKDILDKEDGKSINNSTVKLGDEVTYKLEGWVVPANRGYDLFEYKFVDQLQHTHDLYLRDKVVAKVDVTLKDGTVIKKGTNLGEYTETVYNKTTGHYELAFKKEFLAKVSRESEFGADDFIVVKRIKAGDVYNTADLYVNGYKVKSEAVVTHTTEKSKPVEPQKATPKAPAKGLPSTGEASMTPLTAIGAIILSALGLAGFKKRQK

SEQ ID NO: 278 - protein, 753 aa, Streptococcus agalactiae
MKQIKIITGLTVATLSAVVGNVYAEDITPTAPVNEPQVSSETAKTPQVTESQVNSAKVTADQAISDVNNQQIVVDEAQKQKDQSQQNLVKATSTVTEAEKVAAEATPEVVKEAIKAVTEAKEAVTDAEANVVDAQKTEQKANQEVQSQAKTVDENVKVVADKESEVKQAEGVVTTAQEAIDSKTANTNASEAEKAVTEKQTKLETAETNLTEAQKQDAKIAEEKRLAEQEVVNKQLAVTDTQTLLKKLVTEINNEKVSTSLENQAYFNQRDGSWAGYYGNYTFAATGCVPSSLAMVFTELARRQITPTEIANYLWNNSNEFNKNYGGTSGKGLVQATKHFGFVPTHLASQSAIVEALQAGHHVLAAVQQDKFSPWGINYSHEIVLRGYSNGNTYVYDPYNRANIGWYPVANLWNEQSRDAIDTSSVGVPFFKITTQKMAQLEAQKAQVQSSLNTAKNQLAKTQDVLRTLEATPLKTPEAQAKLNQAKEALALAQADYTKAQEAVKLASQDLAVKEETLKNAQADLLTKQTALKDAQTVLVASQVKLADLKATLATVENNVKKAQATLTDAKAIVGQKQAKLLALQNAPKILADAQAKLVTAKNDLANKMAILDEAVAKLKSLQAVQAEAQKQYHVVFEAYKAVRDAKEQAKLAESYNHIIARGGEAIPVVDETDKITGYVDGSQKAVANEVTLALTSNGAPLESPVNKENQNVTKSSQALPHTGEAGLSILSVLGVGLISTLGLTSLKKRRPH

SEQ ID NO: 279 - protein, 639 aa, Streptococcus agalactiae
VRLTHVSLWMPSKRSWPLKLQLLRKGVIELEDELKTPYLDQYTDNLTAKVTKKSDDYQVYGRNKEVQSVIISLLRRTKNNPILVGEAGVGKSAIVEGITLAILRGQVPEPLKGLTVRSLELSSLMSEDDEGFIAKFKKIIEEMVATRGHNLLFVDEFHTIIGAGSQNGQALDAGNVIKPVLARGDIQLIGATTLDEFHEYIETDRALERRMQPVMVEEPTISQAITIIEQAKVIYEKFHGIQISSDAVHQAIRLSVRYLTDRFLPDKAFDLIDEAATIASVEGKSKVTEKDIAQVLKDKTGIPVTTILKGDQERLEGFKERLMNRVKGQEDAIEAVVDAVTIAQAGLQNEKRPLASFLFLGPTGVGKTELAKAIAEALFDDEAAMIRFDMSEYKQKEDVTKLIGNRATRIKGQLTEGVKQKPYCVLLLDEIEKAHSEVMDLFLQVLDDGRLTDSSGRLISFKNTIVIMTTNIGAKKIINKWELKGNFKDLTDRDRKQFEKSMDSELQNEFRPEFLNRIENKLIFNLLERDVIEKIAEKNLSEIADRMKRQNLTLSYEPSLIQYLSDVGTDVKNGARPLERLMKRKVLAPISVKSLQLDKSKQGYNVHLWVEGRAPDGNHRQEQRQIHMEIEGERDNFFS

SEQ ID NO: 280 - protein, 1576 aa, Streptococcus agalactiae
MAEENAQQPSLRGKSRRERVEFARSRDILDVAHELNMELFRDGKNYRWKEHDSMVITPATNQWYWFSQRQGGDVIALVETIKEIGFNQAFEYLNEGTFKEFTVVNQVKEPFSYYLEPYEQLFVEARRYLKENRGLSDDTIDFFYDKGVLAQANAKVGDMIEPVLVFKNLDKNGQVVGAALQGLVAAPDKYFGRGYLKQIMKNSQPYNGMHVDIGTPNRLVFAESSIDLMSYYEIHKDSLSDVRLVSLEGLKTGTIGRHLIQLRAEMERRPLSSSWTDEILAQGLDEAVKQGYFKDGKNSHLLTLAVDNDVKGKQLIEELKDKSIPVIDATPPKAEGQSKMDWNAYLQETKATFSTEKYQEKIDHLISDVILGDETYYLWHDDELVNLGAGDSIIQAFHHQLEDRRYVINQAELYVEESSNDGATGYLSIEGHVLDKDGISDYLSDQALTDAEKVAFLETLQTELPDIWDEIVNHYDKVFEEVVVKYGLREKHADIIQEQELDLDPLVVPEAKEKSLEMNQETNTGGELFNRNSSFLGEDSPGTAPQPVEPTAQPDFPTNVRLHFTTDDGNMSNKAFRKNMRTLNLYANTMRDSAQWYLSEIADTTMSYVYKTPHEEGVQVLSVHFGKKNWMHLTGVTPVYENWVDSLSEQFIDDIANSKGHFKNLKFALGTPDKLKVLNLLPEIIESDTFVFNDLSSVQKLNNLDLSQALNPEDSDLLLLFRDEGLHQVPASLMRIKGDLEERLSHIDSGTVLGVYRERNGQLEQVSVNEEYVKDSGQEMLSILQNKHYEEALDSGQEMVQTDGFSAEDFTKVLDAVYHVGVPDDLARVPEGVLPVWQKYLEVSEENQWDLEQMIDYADKNSLLVKDSAFYKEWKEDMIYKNDYHVRLQFAENWDNGVELPFRTEQLIDYKTFVTGLYEANQAHHQRRQESQLPYTKTEFDIYAPGGQLIKDNVHYAIGDETRPVSQLMGLGYRRLPGYQELAVIDNSILSQLENKELNQEIASEANEHSLNSQEIPKEDNYPREAFTSPKQDIKKGLAQRVEEIVAEDATKILVSSIPQVQENLSVEGNLVGTPQADNRMLYTNLEDFGQDYQLELAVYSPKRVDFLEDVQAPWTLALIRKEKKIGYLAYGSDWAKEFQIEEELEHLAAQIGDEKVPEGLYKQAEVEAFIASHQGNESLQEPIPTIVAEPFDYTSASAYEISEHAFQKIREYTQSPEDLLEYMDFMSKFPQLSPRNVALIHEQWRGANAVATYEQWKAMGEALGIKPDDVVQTKATYVNKRTGETKEVVHQGLSVKTGEKSKITLFRPLMVKMIPVLDENGQQLKNDKGNPKYKKLSEASLQEKALVKDGKLPVRQFQERDSKTGQPRFTTYKVFELSQTTLKPGSYPKAMPNRHFNFNVDKVKTKEVLEGLCDYAEKIGVSLMKDDAHVLDNAKGAFYSEEQLILINPNNTPGEKIATTIHELAHATLHNPKLEKQYKELPKGQKEFEAEMTSYLLSKHFGLDTSEKAIHYMASWTDNLKALEDKQLADSLKRVHQTVSKMLKQVEKYTNPHQLGRGKEHGLNFPKAPTKGSSR

SEQ ID NO: 281 - protein, 788 aa, Streptococcus agalactiae
MDVSSSPNITFMLQYTEANPQYVDYTNREEAVKIDEELSLETNRQMIEGLTEDELTRIQEAVPETQLNFREYIDYMNRSYATEEQSKELTAIFTQEADYLQKLRLIDLKNKLESAYQNGSLLWQGVISFDNAFLAEQGLYDVATGQVDQKAIKAVMRDMMPTLIQKEGLSDSAFWWGNIHLNTDNIHIHFGLSEVESNREKIFYQPRGRMEYKGNFSQKTINRFKSGVYHGLLKEETRSNLLRKEQILANLKADFITSIYQKDKITSSAEKNFLEQAYNHLPLNKKWRYGSNARDFAVSKFFLDRYLDSYLNNEGSAAYQEFLKETRDFLQTYEGVYSAEKNKIYEKLRKVDGQTIRTLAESKGYDLEHHLARRVMDLRERLANNILRSFREAAPQIQDVQLEKNLESFSVLNQKKILEQHPEASVVKSQKAWQKLGYFVKAGEQPLEIIRPVYKSYDKHGKGIGRPEFVSDTVYDISQLTENIQLKSLTLKDLSLFSSNELKELVDAAKLKTNPTERERRELGTYRYALKLSILESSQKELQVRQKLLEQVQPLASDQPFLDFKKQLIAQELQAIALQLTPNYKLSEDDKALKNRLKRQFEDSVALPVSKATPGAIQLPIRQLWTELGLVHHIQDENILTLLKGTSTTKQAYIEELQTHISIFQLKYQINNRNKQISQLSDEATIKEMRIANAKGFSELKRLYDTLQPSDDGQNQISQAVSKQLQERKVIKKAQLQQTQRSGKINTDFMRQLTASLNRSQQASKKALMERARSDEREEQEERRQAQR

SEQ ID NO: 282 - protein, 266 aa, Streptococcus agalactiae
MKKNKFLLVSIVFIIIFVVQPQNFQSLKNIFTQNDIASQLNISSSPEEKNDGLGTAYQTQNEDLKSKSFDGQHQVIVVNEKAQFTAEELSMRNGSWEKYDNLDFLNRVGVAEAMLGKELMPKEARQDISSVKPTGWKNKKITFNGKQDYLYNRSHLIGFQLSGENANVKNLFTGTRALNANFNDDKSSMVYYENEVANYIKKTNHHVRYRVTPLFKNVELVARGVRIEAQSIEDETISFDVYIFNGQPGYDIDYLTGSSEKIMITK

SEQ ID NO: 283 - protein, 115 aa, Streptococcus agalactiae
VTKEIKIRSIPEKTWAQLHMISEEYEYPSFNEFMLAQLQRIVENGGLDLYDNKFAETLAVIKEQQAQILDQLLKNEIKLLAYHAKQDIVEELTTDWLRFMDDVDALAAERGAGGR

SEQ ID NO: 284 - protein, 280 aa, Streptococcus agalactiae
LLYYFIYLIKVIGNGLKLSLICGLNWLIKIVFKGQFYLFSAVFCGLLTYYMPQDIQLFTVRVLELIIMLKVIIDVTHTALSRDFKRMKTPLFLGVMYVFFLAGNSYIKAHLLTEVMVNHLISFWLISLFFATLVIVIQPRLFKHYLLKKVIDKEYLGIRKFTDSLPPEINLYKDADEEDADKRMRLINQNVIKHPYQEVVELSFLNREVITAIGYKAVPFEKETERTFIDDDTIYYPIFTVHPFRNLEGKSDFYHILMKLKLSRKAAFTKNGERLLIRDF

SEQ ID NO: 285 - protein, 164 aa, Streptococcus agalactiae
MIRNEFYNQLINSEPIGFIDPFTDLGEFDSIQMKFKQPVRNLVNKYSGKPYNLSWQNKIEQMRVLYIKYQKSLKLEDEEQEVHNRVKNKKSKKYVHEIVTTYLKLGFRFKEIEARVSLFNTRLRRNWKRSDYVTTDNPEFYLKKDLQNGYCSPNSFLPRSMKIN

SEQ ID NO: 286 - protein, 423 aa, Streptococcus agalactiae
MNEIKCPHCGTAFAINESEYHQLLEQIRGDAFDKEVSERLEKERLILGEQAKNQLQEVVVEKDKEIAKLQYKVKQFLIEKDNLLKDNEYQLAEQLNQKDMMLRDLENQIDRLRLEHENSLQEALTKVERERDAIQNQLHIQEKEKDLALASVKSDYEVQLKAANEQVEFYKNFKAQQSTKAVGESLEHYAETEFNKVRHLAFPNAYFEKDNTLSSRGSKGDFIYREKDENDLEFLSIMFEMKNESDDTIKKHKNEDFFKELDKDRREKSCEYAVLVTMLEADNDYYNTGIVDVSHKYPKMYVIRPQFFIQLIGILRNAALNTLKYKQELALMKEQNIDITHFEEDLDIFKNAFAKNYNSASKNFQKAIDEIDKSIKRMEAVKAALTTSENQLRLANNKLDDVSVKKLTRKNPTMKAKFDALKD

SEQ ID NO: 287 - protein, 280 aa, Streptococcus agalactiae
MNHFELFKLKKAGLTNLNINNIINYLKKNSLTSLSVRNMAVVSKCKNPTFFIENYKQLDLKKLRQEFKKFPVLSILDSNYPLELKEIYNPPVLLFYQGNIELLSKPKLAVVGARQASQIGCQSVKKIIKETNNQFVIVSGLARGIDTAAHVSALKNGGSSIAVIGSGLDVYYPTENKKLQEYMSYNHLVLSEYFTGEQPLKFHFPERNRIIAGLCQGIVVAEAKMRSGSLITCERALEEGREVFAIPGNIIDGKSDGCHHLIQEGAKCIISGKDILSEYQ

SEQ ID NO: 288 - protein, 118 aa, Streptococcus agalactiae
MTERTFEDIELDLKLFQIKLDNAENSKRLLQKLKNDVMELQIELLESLKLGDAYLTESEELEENNDFILTVNSETLSLSYDNRINLVSKEIMDYENALDKLYYEKQSLMQKSNERKGG

SEQ ID NO: 289 - protein, 410 aa, Streptococcus agalactiae
LFNKIGFRTWKSGKLWLYMGVLGSTIILGSSPVSAMDSVGNQSQGNVLERRQRDAENRSQGNVLERRQRDAENRSQGNVLERRQRDAENRSQGNVLERRQRDAENRSQGNVLERRQRDVENKSQGNVLERRQRDAENKSQGNVLERRQRDAENRSQGNVLERRQRDVENKSQGNVLERRQRDAENRSQGNVLERRQRDVENKSQGNVLERRQRDVENKSQGNVLERRQRDAENRSQGNVLERRQRDVENKSQGNVLERRQRDVENKSQGNVLERRQRDAENRSQGNVLERRQRDAENRSQGNVLERRQRDAENKSQVGQLIGKNPLLSKSIISRENNHSSQGDSNKQSFSKKVSQVTNVANRPMLTNNSRTISVINKLPKTGDDQNVIFKLVGFGLILLTSRCGLRRNEN

SEQ ID NO: 290 - protein, 573 aa, Streptococcus agalactiae
MKRLTYYFKGYIKETIFGPLFKLLEASFELLVPIVIAKMIDETIPRGDRSSLLLQIGLIFFLAAVGVVVAITAQYYSSKAAVGYTRQLTEDLYQKVMSLGKKDRDELGTASLITRLTADTFQIQTGLNQFLRLFLRAPIIVFGAIIMAFSISPSLTIWFLVMVVTLFIIVFVMSRLLNPIYLKIRTSTDYLVKLTRQQLQGVRVIRAFNQVDRESEAFNDINYHYTNLQLKAGRLSSLVTPLTFLVVNITLVVIIWRGNLNIANHLLSQGMLVALINYLLQILVELLKMTMLVTSLNQSYISAKRIIAVFERPSEIIDDKLEPKYSNKALEVQEMAFSYPNSSEKALSDITFSMNVGETLGIIGGTGSGKSTLVNLLLHIYKVQEGDIDIYHQGKSPDTISNWRTLVRVVPQNAQLFKGTIRSNLSLGLGKVSEEKLWTALEIAQASDFVKEKDGQLDAPVESFGRNFSGGQRQRLTIARALVQDKIPFLILDDATSALDYLTEARLFKAITKHFNQTNLIIVSQRINSIQNADRILLLDKGKQVGFDNHQSLLAHNKVYKSIYHSQNFKEEE

SEQ ID NO: 291 - protein, 424 aa, Streptococcus agalactiae
MKFNEQSNSQAALLGLQHLLAMYAGSILVPIMIASALGYNAEQLTYLIATDIFMCGIATLLQLQLSKHFGVGLPVVLGCAFQSVAPLSIIGAQQGSGYMFGALIASGIYVVLVAGIFSKVANFFPPIVTGSVITTIGLTLIPVAMGNMGDNAKEPSLQSLTLSLVTIGVVLLINIFAKGFLKSISILIGLISGTILAAFMGLVDASVVAEAPLVHIPKPFYFGAPRFEFTSILMMCIIATVSMVESTGVYLALSDITNDKLDSKRLRNGYRSEGLAVLLGGLFNTFPYTGFSQNVGLVQISGIRTRKPIYFTALFLVILGLLPKFGAMAQMIPSPVLGGAMLVLFGMVALQGMKMLNQVDFEHNEHNFIIAAVSIAAGVGFNGTNLFISLPNTLQMFLTNGIVISTLTAVVLNIILNGLPKKLI

SEQ ID NO: 292 - protein, 1078 aa, Streptococcus agalactiae
MANTYDLISQRIEAQRQKLIAIDIVAVASSLGLNLKQGSGGHLYWDEHDSFHIYPQTNTFRWWSRSMGTNTIDLVQVIQEELTGKKPSFRETVNFLETGQFESVTVTPVVREPFKHYLAPYEHHNFDLGRQYLKEERGLSDETIDFALASGSMSSATLKKGDYFEPVIIFKSFAEDGRMIGGSLQGIVENKVQHPERGRLKQIMKHSDGLAGFHLDVGTPKRLVFSEAPIDLLSYYELHKESLQNVRLVAMDGVKKGVISRYTADLLTDGQYSQTMPRESIRGAIDAINQTTRILKNNPNMITIAVDNDEAGRNFIKELQEDGIPINVDLPPRKEHQSKMDWNNYLKQKKGLLKMPQTEGTQKAPEQVLEHEKMDRSQISSGSLEDDPQGSAKPVSKRDTFEQAVTSHPTFSYPLLQFSTEEAFVSNVRDGYHIASEEDIRNLNYYAPSLQQTANWYRDNLADRQVTYMLKGDKEIKALQVSFAKDKFAHLTGIRPIGKGLSAEKLLDDFAKGRGSYPNLTLSNGFNDKIQVLPMIQELSQSKSFVFTDLEEVQKMRNLKASHAIQSNNRSLVVALKTIDDVTFPSSLLRGKKNLNDDLIQKAKENEVLGVLSEKDGNITVLSVNDKYIQDGGQALKDMIKNGELEPLQMETIQRHVPHENAYPKDSDGDGLTDDEEIALGTNPFSSDSDGDGTPDNVEKANGTDPTNASDNEVTRQQEANKRDFTLSEMIKAKNTAALNQHLQDGIKQYFDSDTYKQYLEGMAHFNNYSPRNIQLIMSQFPEASMVASFQEWRKRNGSVKKGEKAIYIQAPVSVMKKDENGKPILNPETGEKETITYFKPVPVFDIKQVSPQEGKELNLPKAMGTIPEQLDKEYYQNVYRSLRDISQNNNKVPIRFRELGQEDGFYSPQTNEIVIKKGMSYERTLSTLIHEMAHSELHNKQSLTERFDGKLTRSTKELQAESIAYVVSSHLGFDTSQESFPYLASWSKEKDGLANLTAQLEIVQEEAKNLMERIDQQLSQYQTVTLNKETQQLTKQEMKKQTHPFYQSLAAAKTSRAQVTTQEKEASVKKDNRPTMP

SEQ ID NO: 293 - protein, 932 aa, Streptococcus agalactiae
MNSQETKGHGFFRKSKAYGLVCGIALAGAFTLATSQVSADQVTTQATTQTVTQNQAETVTSTQLDKAVDTAKKAAVAVTTTTAVNHATTTDAQADLANQTQAVKDVTAKAQANTQAIKDATAENAKIDAENKAEAERVAKANKAGQAEVDARNKAGQAAVDARNKAKQQAQDDQKAKIDAENKAESQRVSQLNAQNKAKIDAENKDAQAKADATNAQLQKDYQTKLANIKSVEAYNAGVRQRNKDAQAKADATNAQLQKDYQAKLALYNQALKAKAEADKQSINNVAFDIKAQAKGVDNAEYGNSIMTAKTKPDGSFEFNHDMIDGVKTIGYGKLTGKVNHHYVANKDGSVTAFVDSVTLYKYEYRNVAQNAAVNQNIVFRVLTKDGRPIFEKAHNGNKTFAETLNKTLQLNLKYELKPHASSGNVEVFKIHDDWVHDTHGSALVSYVNNNDAVPNVVIPEQPTPPKPEKVTPEAEKPVPEKPVEPKLVTPVLKTYTPVKFIPREYKPVPSTPETFTPEKFTPAQPKVKPHVSVPEKINYKVAVHPVQIPKATPTKKVLDENGQSINGKSVLPNATLDYVAKQNFSQYKGIKASAEAIAKGFAFVDQPNEALAELTVKSIKASNGDDVSSLLEMRHVLSKDTLDQKLQSLIKEAGISPVGEFYMWTAKDPQAFYKAYVQKGLDITYNLSFKVKKEFTKGQIKNGVAQIDFGNGYTGNIVVNDLTTPEVHKDVLDKEDGKSINNGTVKLGDEVTYKLEGWVVPANRGYDLFEYKFVDHLQHTHDLYLKDKVVAKVAITLKDGTVIPKGTNLVQYTETVYNKETGRYELAFKADFLAQVSRSSAFGADDFIVVKRIKAGDVYNTADFFVNGNKVKTETVVTHTPEKPKPVMPQKVTPKAPALPSTGEQGVSVLTVLGAALLSLLGLVGFKKRQQ

SEQ ID NO: 294 - protein, 743 aa, Streptococcus agalactiae
MNQIKIITGLTVATLSAVVGNVYAEDITPTAPVNEPQVSSETAKTPQVTESQVNSAKVTADQATSDVNAQKNVVNNAQNQKNQAQQKLVNATTTLNETQKLVQESTNQNQVQQTVDSAKQRLSQTEANQKITQTEQVKAQNQVNAQQTVVVNNEHDVATKTADVKQAQASVDTAKDALTNTIVNSDLNKAQSNVTTKTADVKTATDALTKAQATDKTLTNQKAKAQQIVDSAKQNLSAKDTQLSQANAEVNHHKFKTALGQSHYYNQRDNAWAGVYGGHTFASTGCVPSALAMVYSDLSNRTITPREIADYLYNNTDEFNKRFGGTSGKGIISATKAFGYVVTHLASKNAITEALKAGHHVVAAVQNNKFSPWGPQYSHEIVLRGSSNGNTYVYDPYNRDNNGFYSVDRIWNEQSRDSIDTAGVGVPFFAIMTKNMANALTKQSQALASQQVAQKQLNDAQAKATGLNAVTMQTPIAQANLIKAQSNLKDAQKRLAEAQASVKLANQDNVKKQADLTKAESKLKDAQKQLAAAQAKLTTSKTKLNQLKQVLAEASQQVAQANQDYKQAKDNLTQKTAYLTNLRNAQANLIKAQSDVAQAKDNLANKIAKLQREVAYLQELKTKAVDAQSQYQKVLSAYKSVLSAKASLKLAEEKARLDKKGHEAVAVVDETGKITSYITSKHKIEMKSLVATKTTDVKQVSVAKASVLPSTGDVKQVSVALLGMLLTFSGFLGIRKQSKKVIN

SEQ ID NO: 295 - protein, 253 aa, Streptococcus agalactiae
MISRKVALVTGASAGFGAAIVTKLVSDGYSVIGCARRMDKLKCFGEKFSEGYFYPLQMDITSRESVDKALESLPKNLQSIDLLVNNAGLALGLDKSYEADFEDWMTMINTNVVGLIYLTRCILPKMVEVNRGLIINLGSTAGTIPYPGANVYGASKAFVKQFSLNLRADLAGTKIRVTNLEPGLCEGTEFSTVRFKGDHKRVEKLYEGAHAIQAEDIANTVSWVASQPEHININRIEIMPVSQTYGPQPVYRD

SEQ ID NO: 296 - protein, 371 aa, Streptococcus agalactiae
MIYLDNAATTALTPSVIEKMTNVMTSNYGNPSSIHTFGRQANQLLRECRQIIAEYLNVNSREIIFTSGGTESNNTAIKGYALANQLKGKHIITSEIEHHSVLHTMTYLSERFGFDITYLKPNHGQITAKDVQEALRDDTIMVSLMFANNETGDFLPIQEIGQLLRNHQAVFHVDAVQVFSKMELDPHSLGIDFLAASAHKFHGPKGVGILYCAPHHFDSLLHGGDQEEKRRASTENIIGIAGMSQALTDATTNTLKNWTHISQLRTTFLDAISDLDFYLNNGQDCLPHVLNIGFPRQNNGLLLTQLDLAGFAVSTGSACTAGTVEPSHVLTSLYGANSPRLNESIRISFSELNTQEEILELAKTLRKIIGD

SEQ ID NO: 297 - protein, 447 aa, Streptococcus agalactiae
MSRKTFKHILSIGVCTLVLSMSLYYTEKAHAIAGPSDRQYVENPNPHIIVNVTGTDQNGNSILPHYIEVNVKMGQTLSKEEILDYIARNLNSSVGGESKNVQYSNIEFKESAYLKRQLDDGKTEEIAIDNDGVTVPKDGPNKFWIDVPVTCTVTPIVTETHEVRWGTPVAISHRIYFVEESSGKVLDEYTNLHTADSELNGYRVGDYITDYALSKSAYEAFLNSRLDKEGYKLQHRISTNVRQNLQIDKLIFNYDFNEENIYYQIGNIRPLLSRSSAEVESDIITERYYVSKNAKSLARTESTISIKMVDAKTEQPLFNHTLTGYQLATVSHVYNRLFEENLIPTTKSGERYFIQNMKKTAEQEYTVYLSETPYSKENAPVISYDARPVDWDYHSGASGSLENQPNIYTEEDSTEFLGNKPQAACYPNKQFACENTDSKYNYSYLEK

SEQ ID NO: 298 - protein, 759 aa, Streptococcus agalactiae
MNPLIIGMNDKQAEAVQTTDGPLLIMAGAGSGKTRVLTHRIAYLIDEKYVNPWNILAITFTNKAAREMRERAIALNPATQDTLIATFHSMCVRILRREADYIGYNRNFTIVDPGEQRTLMKRIIKQLNLDTKKWNERSILGTISNAKNDLLDEIAYEKQAGDMYTQVIAKCYKAYQEELRRSEAMDFDDLIMMTLRLFDQNKDVLAYYQQRYQYIHVDEYQDTNHAQYQLVKLLASRFKNICVVGDADQSIYGWRGADMQNILDFEKDYPQAKVVLLEENYRSTKKILQAANNVINHNKNRRPKKLWTQNDEGEQIVYHRANNEQEEAVFVASTIDNIVREQGKNFKDFAVLYRTNAQSRTIEEALLKSNIPYTMVGGTKFYSRKEIRDVIAYLNILANTSDNISFERIVNEPKRGVGPGTLEKIRSFAYEQNMSLLDASSNVMMSPLKGKAAQAVWDLANLILTLRSKLDSLTVTEITENLLDKTGYLEALQVQNTLESQARIENIEEFLSVTKNFDDNPEITVEGETGLDRLSRFLNDLALIADTDDSATETAEVTLMTLHAAKGLEFPVVFLIGMEEGVFPLSRAIEDADELEEERRLAYVGITRAEQILFLTNANTRTLFGKTSYNRPTRFIREIDDELIQHQGLARPVNSSFGVKYSKEQPTQFGQGMSLQQALQARKSNSQPQVTAQLQALNANNSHETSWEIGDVATHKKWGDGTVLEVSGSGKTQELKINFPGIGLKKLLASVAPISKKEN

SEQ ID NO: 299 - protein, 130 aa, Streptococcus agalactiae
MKLYVQLMVILTFSFAGEVLSTIFNLPVPGSIIGLILLFLALKYKIIRLRHIDAVGNFLLANMTILFLPPAVGLMEHFQDIKPYLFGIAIIILGALFLNILTIGLVSQWIKKRYEGDYPEIGGKNGNFNE

SEQ ID NO: 300 - protein, 157 aa, Streptococcus agalactiae
MIFVTVGTHEQQFNRLIKEVDRLKGTGAIDQEVFIQTGYSDFEPQNCQWSKFLSYDDMNSYMKEAEIVITHGGPATFMSVISLGKLPVVVPRRKQFGEHINDHQIQFFKKIAHLYPLAWIEDVDGLAEVLKRNIATEKYQGNNDMFCHKLEKIIGEI

SEQ ID NO: 301 - protein, 253 aa, Streptococcus agalactiae
MVMKIIELKEATVQVSNGLAEMKTILDHVNLSIYEHDFITILGGNGAGKSTLFNVIAGTLMLSGGNIYIMGQDVTNLPAEKRAKYLSRVFQDPKMGTAPRMTVAENLLVAKFRGEKRPLVPRKITNYTEEFQKLIARTGNGLDRHLETPTGLLSGGQRQALSLLMATLKKPNLLLLDEHTAALDPRTSVSLMGLTDEFIKQDSLTALMITHHMEDALKYGNRILVMKDGKIVRDLNQAQKNKMAIADYYQLFD

SEQ ID NO: 302 - protein, 1072 aa, Streptococcus agalactiae
MEIKKKHRIMLYSALILGTILVNNSYQAKAEELTKTTSTSQIRDTQTNNIEVLQTESTTVKETSTTTTQQDLSNPTASTATATATHSTMKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKMLNDSTVATKPLKSNLSTFNSMDRLAYYNAEKDFGFALSLHSKRTLNYEGMNDENTRDWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 303 - protein, 77 aa, Streptococcus agalactiae
MHSFSNPGYPYDNAVTEAFFKYLKHRQINRKHYQNIKQVQLDCFEYIENFYNNYNPHTANLGLTPNQKEENYFNAIK

SEQ ID NO: 304 - protein, 822 aa, Streptococcus agalactiae
VKKTYGYIGSVAAILLATHIGSYQLGKHHMGLATKDNQIAYIDDSKGKAKAPKTNKTMDQISAEEGISAEQIVVKITDQGYVTSHGDHYHFYNGKVPYDAIISEELLMTDPNYRFKQSDVINEILDGYVIKVNGNYYVYLKPGSKRKNIRTKQQIAEQVAKGTKEAKEKGLAQVAHLSKEEVAAVNEAKRQGRYTTDDGYIFSPTDIIDDLGDAYLVPHGNHYHYIPKKDLSPSELAAAQAYWSQKQGRGARPSDYRPTPAPGRRKAPIPDVTPNPGQGHQPDNGGYHPAPPRPNDASQNKHQRDEFKGKTFKELLDQLHRLDLKYRHVEEDGLIFEPTQVIKSNAFGYVVPHGDHYHIIPRSQLSPLEMELADRYLAGQTEDNDSGSEHSKPSDKEVTHTFLGHRIKAYGKGLDGKPYDTSDAYVFSKESIHSVDKSGVTAKHGDHFHYIGFGELEQYELDEVANWVKAKGQADELAAALDQEQGKEKPLFDTKKVSRKVTKDGKVGYMMPKDGKDYFYARDQLDLTQIAFAEQELMLKDKKHYRYDIVDTGIEPRLAVDVSSLPMHAGNATYDTGSSFVIPHIDHIHVVPYSWLTRDQIATVKYVMQHPEVRPDVWSKPGHEESGSVIPNVTPLDKRAGMPNWQIIHSAEEVQKALAEGRFATPDGYIFDPRDVLAKETFVWKDGSFSIPRADGSSLRTINKSDLSQAEWQQAQELLAKKNTGDATDTDKPKEKQQADKSNENQQPSEASKEEKESDDFIDSLPDYGLDRATLEDHINQLAQKANIDPKYLIFQPEGVQFYNKNGELVTYDIKTLQQINP

SEQ ID NO: 305 - protein, 306 aa, Streptococcus agalactiae
MKKGFFLMAMVVSLVMIAGCDKSANPKQPTQGMSVVTSFYPMYAMTKEVSGDLNDVRMIQSGAGIHSFEPSVNDVAAIYDADLFVYHSHTLEAWARDLDPNLKKSKVDVFEASKPLTLDRVKGLEDMEVTQGIDPATLYDPHTWTDPVLAGEEAVNIAKELGRLDPKHKDSYTKKAKAFKKEAEQLTEEYTQKFKKVRSKTFVTQHTAFSYLAKRFGLKQLGISGISPEQEPSPRQLKEIQDFVKEYNVKTIFAEDNVNPKIAHAIAKSTGAKVKTLSPLEAAPSGNKTYLENLRANLEVLYQQLK

SEQ ID NO: 306 - protein, 1150 aa, Streptococcus agalactiae
LRKKQKLPFDKLAIALMSTSILLNAQSDIKANTVTEDTPATEQTVETPQPTAVSEEAPSSKETKTPQTPSDAGETVADDANDLAPQAPAKTADTPATSKATIRDLNDPSQVKTLQEKAGKGAGTVVAVIDAGFDKNHEAWRLTDKAKARYQSKEDLEKAKKEHGITYGEWVNDKVAYYHDYSKDGKTAVDQEHGTHVSGILSGNAPSETKEPYRLEGAMPEAQLLLMRVEIVNGLADYARNYAQAIRDAINLGAKVINMSFGNAALAYANLPDETKKAFDYAKSKGVSIVTSAGNDSSFGGKTRLPLADHPDYGVVGTPAAADSTLTVASYSPDKQLTETATVKTADQQDKEMPVLSTNRFEPNKAYDYAYANRGTKEDDFKDVKGKIALIERGDIDFKDKIAKAKKAGAVGVLIYDNQDKGFPIELPNVDQMPAAFISRKDGLLLKDNPQKTITFNATPKVLPTASGTKLSRFSSWGLTADGNIKPDIAAPGQDILSSVANNKYAKLSGTSMSAPLVAGIMGLLQKQYETQYPDMTPSERLDLAKKVLMSSATALYDEDEKAYFSPRQQGAGAVDAKKASAATMYVTDKDNTSSKVHLNNVSDKFEVTVTVHNKSDKPQELYYQATVQTDKVDGKHFALAPKALYETSWQKITIPANSSKQVTVPIDASRFSKDLLAQMKNGYFLEGFVRFKQDPKKEELMSIPYIGFRGDFGNLSALEKPIYDSKDGSSYYHEANSDAKDQLDGDGLQFYALKNNFTALTTESNPWTIIKAVKEGVENIEDIESSEITETIFAGTFAKQDDDSHYYIHRHANGKPYAAISPNGDGNRDYVQFQGTFLRNAKNLVAEVLDKEGNVVWTSEVTEQVVKNYNNDLASTLGSTRFEKTRWDGKDKDGKVVANGTYTYRVRYTPISSGAKEQHTDFDVIVDNTTPEVATSATFSTEDRRLTLASKPKTSQPVYRERIAYTYMDEDLPTTEYISPNEDGTFTLPEEAETMEGATVPLKMSDFTYVVEDMAGNITYTPVTKLLEGHSNKPEQDGSDQAPDKKPEAKPEQDGSGQTPDKKTETKPEKDSSGQTPGKTPQKGQPSRTLEKRSSKRALATKASTRDQLPTTNDKDTNRLHLLKLVMTTFFLGLVAHIFKTKRQKETKK

SEQ ID NO: 307 - protein, 403 aa, Streptococcus agalactiae
FSVTYSQSERTVVFSFGEITFSRSRWTNGFETRIPVDEWLGLEKYKRYSIEFLYHVAKLATMMPYRQVCKVIDSTLQTIITKDCVLKAVKFVEKLLKEKERYRFYLEEPPERKKVKKLYVEGDGVMIKSTDSREERRYLDLTHFVIHTGSKKVSTKRYELQDKHEILQLNYDKAKYNLLDYIYNNYEVDDDTILITNSDMGKGYTSRVFKELGKALKVKKHEHFWDIYHVKEKLSSYLRKYPIELTDFALDAVKKYNSDKLELVFDTVESLICDELEDQEFQKFKKKVLNNFKYIKPAHLRNLSNRGIGIMESQHRKITYRMKRRGMYWSKWGISTMANMIILERANGLRELFFGSWRKVYSEYKEGSFSAGRLFKKTDELDKFSKPLLKNGRKWSITGIKTK

SEQ ID NO: 308 - protein, 278 aa, Streptococcus agalactiae
KASSGDYGTKREIITANKDKYSISKMCRWLNMPRSSYYYQAVESVSKTEFEETIKRIFLDSESRYGSRKIKICLNNEGITLSRRRIRRIMKRLNLVSVYQKATFKPHSRGKNEAPIPNHLDRQFKQERPLQALVTDLTYVRVGNRWAYVCLIIDLYNREIIGLSLGWHKTAELVKQAIQSIPYALTKVKMFHSDRGKEFDNQLIDEILEAFGITRSLSQAGCPYDNAVAESTYRAFKIEFVYQETFQSLEELALKTEKATLFCTTFIKCCLFRFLPML

SEQ ID NO: 309 - protein, 104 aa, Streptococcus agalactiae
MKTRNRKGGYLANTANEYIDSKQAIHCLSVELEPQIRFEEGQPTGEIIAYKAWFSQKGLPPFMVKFENEVTLPAYMVMVQFENLQACEVGFNVYFKADNLKEVK

SEQ ID NO: 310 - protein, 2066 aa, Streptococcus agalactiae
LSTFDSVTGRTNHLEAYEGLNLSEKFAILSHFDKLRNELQTPSIQLGEFDREMEAFSITLGNELLGYLEANGSPYELKRELNQAEMMAVLELSRQLVAKFSTKLEELGIDLGSFQPDQVNILLDAVGRFRLKNADIALLGGYPKASVSQLALATELLQMGLSHDKVEFFLTSQLQLEDMRQVAFAFLHESLTREEAEQFETDRFRHTSLNFREWRELLEKQEPEMVEMSDVSPLVREVLHHYPLGSRVTYKGQEFEILSIEAADMDNLIRIELQNDFSYLIEQNPVLYFQNLAEIRQVLHLSRSEIVEREEQPEEEWTLFSFMDEGTEDNEKEPEIVFESTDKVVTLDSQPAQVSETISESVPETKEVIEAEQAIAVDFSFPEDLTNFYPKTARDKVVANLVAIRLVKELESANQSATPNEQEILAKYVGWGGLANEFFDEYNPKFSKEREELKTLVSDKEYSDMKQSSLTAYYTDPLLIRQMWSKLEQDGFSGGKILDPSMGTGNFFAAMPAHLREKSELCGVELDTITGAIAKQLHSNVHIEVKGFETVAFNDNSFDLVISNVPFANIRIADNQYDKPYMIHDYFVKKSLDLVHDGGQVAIISSTGTMDKRTENILQDIRETTDFLGGVRLPDTAFKAIAGTSVTTDMLFFQKHLNKGYQADDIAFSGSVRYDKDERIWLNPYFDGEYNAQVLGRYEIKNFNGGTLSVKETTDNLIASVREALQHVKAPRVIDKTEVMINSDVIARQVIDTTIPPEIRENLEQYSYGYKGSTIYYRDNKGIRVGTKTEEISYYVDDEGNFQAWESKHSQKQIDRFNNLEVTDSTALDVYVTEEPAKRGQFKGYFKKAVFYEAPLSEKEVARIKGMVDIRNAYQEVIAIQRNYDYDKNEFNRLLGNLNRTYDSFVKRYGFLNSPVNRNLFDSDDKYSLLASLEDESLDPSGKTVIYTKSLAFEKALVRPEKMVKEVSTALDALNSSLADGRGVDFDYMASIYQTASKAALIEELGDQIIPDPESYLKGQLTYVSRQEFLSGDIVTKLEVMDLLLKQDNHDFNWAHYGNLLESVRPARVMLADIDYRIGSRWIPLAVYGKFVQEAFMGKNYDLTATEVEEVLSVSPIDGTMEFRTRFAYTYSTATDRSLGVAGSRYDSGRKIFENLLNSNQPTITKQIQEGDKKKNVTDVEKTTVLRAKEAQIQDLFQDFVASYPEAQQMIEDTYNSLYNRTVSKVYDGSRLEIDGLAQNISLRPHQKNAIQRIVEEKRALLAHEVGSGKTLTILGAGFKLKELGMVHKPLYVVPSSLTAQFGQEIMKFFPTKKVYVTTKKDFAKARRKQFVSRIITGDYDAIVIGDSQFEKIPMSQEKQVTYIQDKLEQLREIKQGSDSDYTVKEAERSIKGLENQLEELQKLDRDTFIEFENLGIDFLFVDEAHHFKNIRPITGLGNVAGITNTTSKKNVDMEMKVRQIQAEYGDRNVVFATGTPVSNSISELYTMMNYIQPDVLERYQVSNFDSWVGAFGNIENSMELAPTGDKYQPKKRFKKFVNLPELMRIYKETADIQTSDMLDLPVPEATVIAVESELTEAQKNYLEELVDRSDAIKSGSVDPSVDNMLKVIGEARKLAIDMRLIDPAYTLSDNQKIMQVVDNVERIYREGKGDKATQMIFSDIGTPKSKEEGFDVYNELKALLVDRGIPKEEIAFVHDANTDEKKNSLSRKVNSGEVRILMASTEKGGTGLNVQARMKAVHHLDVPWRPSDIQQRNGRLIRQGNQHQNVEIYHYITKGSFDNYLWATQENKLRYIKQIMTSKDPVRSAEDIDEQTMTASDFKALATGNPYLKLKMELENELTVLENQKRAFNRSKDEYRHTISYCEKNLPVMEKRLRQYDRDIEKSQATKNQEFIMRFDNQTIDNRSEAGDYLRKLITYNRSETKEVRTLATFRGFELKMATRSPGEPLSDMVSLTISGDNQYSVSLDLKSDVGTIQRINNAIDHILEDKEKTEEMTNNLKDKLAVARVEVEKVFAKEEEYQLVKAKYDVLAPLVEREADLEEIDVALSQFSSSDPCLKKDQQLVLDI

SEQ ID NO: 311 - protein, 1634 aa, Streptococcus agalactiae
MTTKCNHHFLINQEKGEKYVFRKSKQYRTLCSVALGTVVMAFVALAGPMVQADEVGRTVATSVQTETNPATNLKENQPSPIAEQKDSLAATGQSTGTVTVTVPHDKVTQAVDKAKTEGIKAVQDKPMDLGNTVSAAETSQQLKKAEEDATNQTTTISKTVEIYKSDKATYEAEKKWVEKRNEELTAAYDKAEQTGTGLNHSVDTTVSELKSQDQNAHVTVNTQTVKSGDGTSVSGYQEYVKSVAAIDKKNKANLADYRTKKQAADAVVAKNQLIQKENEAGLAKAKAENEAIDRRNKEGQKAVDEANKAGQAAVEQANQEKQKQAANRAFEIATITKRNKEREEVAKKENAAIDAYNAKEWIRYKRDLANISKGEEGYISEALAQALDLNHGEPQVKHGAGTRNPDRIISKGDAMLGGYSNILDSTGFFVYNHFKTGETLNFTYQNLKHARFDGKKITAITYDITNLVSPTGTNAVQLVVPNDPTEGFIAYRNDGAGNWRTDKMEFRVKARYFLEDGSQVTFTKEKPGVFTHSSLNHNDIGLEYVKDSSGKFVPIHGSSVQVTNEGLARSLGSNRASDLKLPEEWDTTSSRYAYKGAIVSTVTSGNIYTVTFGQGDMPTQVGGKTYWFALNTLPVAKTVTPYNPKTHVRPQLDPVPEPIKVTPETYTPKIFTPEKPVTFTPKSVEKVPQPSLTLTKVTLPTNLKLEPLPKAPQKPTVHYHDYLLTTTPAIAKEVMNVDKVNLHGKQVAKDSTVIYPLTVDVLSPNRSKITSLIFEDYLPAGYAFDMTKTQAENSDYDLTFDKNKNFVTLKAKDSLLQTLNKELNKSYQLSAPKLYGSVQNDGATYSNSYKLLINKDTPNTYTVISNVVRIRTPGDGETTSRIRPKKDNENADGVLINDTVVALSTTNHYRLTWDLDQYKGDTSSKDTIARGFLFVDDYPEEALDLVDKGTVITTLDGKAVSGISVYSYTSLDKAPKELQDKLARANISPKGAFQVFEPDNHQAFYDTYVKTGQSLALLTKMKVKDSLYGQTVRYKNKAYQVDFGNGYETKEVVNTVVHPEPKKQNLNKDKVDINGKAMLVGSQNFYTLSWDLDQYRGLQADKSQIAQGFYFVDDYPEDVLLPDTKAIQIMTKDGKAVKGMEIKTYHQLSDAPKELQAALAKRNITPKGAFQVFMPKDPQAFYKAYVTTGQNLTIVNPMTVREAVYNSGKSYDNVAYQVDFGQAYETNIVTNHVPTVNPHKSNTNKEGVSIEGKTVLPNTVNYYKIVLDYSQYKNMIVTDDVLVKGFYMVDDYPEEALTPHPDGTQVMDQNGKFVRGLSVRTYASLADAPKAVQEAMKSRNFIPKGAIQVFQADDPKTFFETYVKTGQKLVVTTPMTVKNERIQTGGQYENTAYQIDFGIAYVTETVVNNVPKLEPQKDVVIDLSQKDKSLNGKAIALDQVFNYRLVGSLIPRNRATALVEYSFKDDYDEKHDEYKGVYKAYTLRDVTLKDGTVLKQGTEVTKYTLQSVDKAKGTIAIRFDTAFLENIADESEFQAELYLQMKRIASGDVENTVIHSVNGYNIRSNTVKTTTPQPESPTPDNPPSPQPPVPTTESPVQASVLPSTGESQSLLALIGGGLLLGLAYGLSKRKKEKN

SEQ ID NO: 312 - protein, 702 aa, Streptococcus agalactiae
MANNNFYNRDPFGNMDDIFNSLMGNMGGYNSENKRYLINGREVTPEEFSQYRQTGKLPGQELNNQNTPTNQVSADSVLTKLGTNLTDQARQHLLDPVIGRNKEIQETAEILARRTKNNPVLVGDAGVGKTAVIEGLAQAIINGDVPAAIKNKEIISIDISSLEAGTQYRGSFEENIQNIIKEVKETGNIILFFDEIHQILGAGSTGGDSGSKGLADILKPALSRGELTVIGATTQDEYRNTILKNAALARRFNEVKVNAPSAQDTFNILMGIRNLYEQHHNVVLPDSVLKAAVDLSIQYIPQRSLPDKAIDLIDMTAAHLAAQHPVTDLKSLEKEIAAQRDKQEKAVNTEDFEEALKVKTRIEELQNQIDNHTEGQKVTATINDIAMSIERLTGVPVSNMGASDIERLKELGNRLKGKVIGQNDAVEAVARAIRRNRAGFDDGNRPIGSFLFVGPTGVGKTELAKQLAFDMFGSKDAIVRLDMSEYNDRTAVSKLIGATAGYVGYDDNSNTLTERIRRNPYSIVLLDEIEKADPQVITLLLQVLDDGRLTDGQGNTINFKNTVIIATSNAGFGNEAFTGDSDKDLKIMERISPYFRPEFLNRFNGVIEFSHLSKDDLNEIVDLMLDEVNQTIGKKGIDLVVDENVKSHLIDLGYDEAMGVRPLRRVIEQEIRDRITDYYLDHTDVKHLKANLQDGQIVISER

SEQ ID NO: 313 - protein, 314 aa, Streptococcus agalactiae
MGRFKELLESKKALILHGALGTELESRGCDVSGKLWSDKYLIEDPAAIQTIHEDYIRAGADIVTTSTYQATLQGLAQVGVSESQAEDLIRLTVQLAKAVREQVWKSLTKEEKSERIYPLISGDVGPYAAFLADGSEYTGLYDIYKEGLKNFHRHRIELLLDEGVDLLALETIPNAQEAEALIELLVEDFPQVEAYMSFTSQDGKTISDGSAVAGLAKAIDVSPQVVALGINCSSPSLVADFLQAIAEQTDKPLVTYPNSGEIYDGASQSWQSSRDHSHTLLENTSDWQKLGAQVVGGCCRTRPADIADLSEHLT

SEQ ID NO: 314 - protein, 390 aa, Streptococcus agalactiae
MKIGIDKIGFATSQYVLEMTDLAIARQVDPEKFSKGLLLDSLSITPVTEDIVTLAASAANDILSDEDKETIDMVIVATESSIDQSKAASVYVHQLLEIQPFARSFEMKEACYSATAALDYAKLHVEKHPDSKVLVIASDIAKYGIKSTGESTQGAGSIAMLISQNPSILELKEDRLAQTRDIMDFWRPNYSDVPYVNGMFSTKQYLDMLKTTWKEYQKRFNTSLSDYAAFCFHIPFPKLALKGFNKILDNNLDEQKKAELQENFEHSITYSKKIGNCYTGSLYLGLLSLLENSQNLKAGDQIAFFSYGSGAVAEIFTGQLVDGYQNKLQSDRMDQLNKRQKITVTEYEKLFFEKTILDENGNANFNTYRTGTFSLDSICEHQRIYKKINN

SEQ ID NO: 315 - protein, 304 aa, Streptococcus agalactiae
MKSAYIFFNPKSGKDEQALAQEVKSYLIEHDFQDDYVRIITPSSVEEAVALAKKASEDHIDLVIPLGGDGTINKICGGVYAGGAYPTIGLVPAGTVNNFSKALNIPQERNLALENLLNGHVKSVDICKVNDDYMISSLTLGLLADIAANVTSEMKRKLGPFAFVGDAYRILKRNRSYSITLAYDNNVRSLRTRLLLITMTNSIAGMPAFSPEATIDDGLFRVYTMEHIHFFKLLLHLRQFRKGDFSQAKEIKHFHTNNLTISTFKRKKSAIPKVRIDGDPGDQLPVKVEVIPKALKFIIPNSLP

SEQ ID NO: 316 - protein, 284 aa, Streptococcus agalactiae
MTTFTAKFIDQEWEVPVESGRYHMIVGEFCPYAQRPQIARQLLGLDKHISISFVDDVPSDIGLIFSQPEQVTGAKSLRDIYHLTDPTYKGPYTIPILIDKTDNRIVCKESADMLRLFTTDFSDLHQEDAPVLFSQETASLIDNDIKDINNNFQSLMYKLAFLDKQADYDTYSKEFFTFLDQKEHLLGQRPFLLGDNLSEVDIHFFTPLVRWDIAGRDLLLLNQKALEDYPNIFSWAKTLYNDFNLKTLTNPQSIKNNYYLGKFGRAVRHHTIVPTGPNMVKWEK

SEQ ID NO: 317 - protein, 690 aa, Streptococcus agalactiae
MKKKIILKSSVLGLVAGTSIMFSSAFADQVGVQVIGVNDFHGALDNTGTANMPDGKVTNAGTAAQLDAYIDDAQKDFKQTNPNGESIRVQAGDMVGASPANSGLLQDEPTVKTFNAMNVEYGTLGNHEFDEGLAEYNRIVTGKAPAPDSNINNITKSYPHEAAKQEIVVANVIDKVNKQIPYNWKPYAIKNIPVNNKSVNVGFIGIVTKDIPNLVLRKNYEQYEFLDEAETIVKYAKELQAKNVKAIVVLAHVPATSKDDIAEGEAAEMMKKVNQLFPENSVDIVFAGHNHQYTNGLVGKTRIVQALSQGKAYADVRGVLDTDTQDFIETPSAKVVAVAPGKKTGSADIQAIVDQANTIVKQVTEAKIGTAEVSGMITRSVDQDNVSPVGSLITEAQLAIARKSWPDIDFAMTNNGGIRADLLIKPDGTITWGAAQAVQPFGNILQVVEITGRDLYKALNEQYDQKQNFFLQIAGLRYTYTDNKEGGEETPFKVVKAYKSNGEEINPDAKYKLVINDFLFGGGDGFASFRNAKLLGAINPDTEVFMAYITDLEKAGKKVSVPNNKPKIYVTMKMVNETITQNDGTHSIIKKLYLDRQGNIVAQEIVSDTLNQTKSKSTKINPVTTIHKKQLHQFTAINPMRNYGKPSNSTTVKSKQLPKTNSEYGQSFLMSVFGVGLIGIALNTKKKHMK

SEQ ID NO: 318 - protein, 579 aa, Streptococcus agalactiae
MAYIWSYLKRYPNWLWLDLLGAMLFVTVILGMPTALAGMIDNGVTKGDRTGVYLWTFIMFIFVVLGIIGRITMAYASSRLTTTMIRDMRNDMYAKLQEYSHHEYEQIGVSSLVTRMTSDTFVLMQFAEMSLRLGLVTPMVMIFSVVMILITSPSLAWLVAVAMPLLVGVVLYVAIKTKPLSERQQTMLDKINQYVRENLTGLRVVRAFARENFQSQKFQVANQRYTDTSTGLFKLTGLTEPLFVQIIIAMIVAIVWFALDPLQRGAIKIGDLVAFIEYSFHALFSFLLFANLFTMYPRMVVSSHRIREVMDMPISINPNAEGVTDTKLKGHLEFDNVTFAYPGETESPVLHDISFKAKPGETIAFIGSTGSGKSSLVNLIPRFYDVTLGKILVDGVDVRDYNLKSLRQKIGFIPQKALLFTGTIGENLKYGKADATIDDLRQAVDISQAKEFIESHQEAFETHLAEGGSNLSGGQKQRLSIARAVVKDPDLYIFDDSFSALDYKTDATLRARLKEVTGDSTVLIVAQRVGTIMDADQIIVLDEGEIVGRGTHAQLIENNAIYREIAESQLKNQNLSEGE

SEQ ID NO: 319 - protein, 543 aa, Streptococcus agalactiae
MKKGQVNDTKQSYSLRKYKFGLASVILGPFIMVTSPVFADQTTSVQVNNQTGTSVDANNSSNETSASSVITSNNDSVQASDKVVNSQNTATKDITTPLVETKPMVEKTLPEQGNYVYSKETEVKNTPSKSAPVAFYAKKGDKVFYDQVFNKDNVKWISYKSFCGVRRYAAIESLDPSGGSETKAPTPVTNSGSNNQEKIATQGNYTFSHKVEVKNEAKVASPTQFTLDKGDRIFYDQILTIEGNQWLSYKSFNGVRRFVLLGKASSVEKTEDKEKVSPQPQARITKTGRLTISNETTTGFDILITNIKDDNGIAAVKVPVWTEQGGQDDIKWYTAVTTGDGNYKVAVSFADHKNEKGLYNIHLYYQEASGTLVGVTGTKVTVAGTNSSQEPIENGLAKTGVYNIIGSTEVKNEAKISSQTQFTLEKGDKINYDQVLTADGYQWISYKSYSGVRRYIPVKKLTTSSEKAKDEATKPTSYPNLPKTGTYTFTKTVDVKSQPKVSSPVEFNFQKGEKIHYDQVLVVDGHQWISYKSYSGIRRYIEI

SEQ ID NO: 320 - protein, 415 aa, Streptococcus agalactiae
MENWKFALSSILGHKMRAFLTMLGIIIGVASVVLIMALGKGMKDSVTNEITKSQKNLQIYYKTKEDQKNEDNFGAQGAFMQGSDTNRKEPIIQESWLKKIAKEVDGVSGYYVTNQTNAPVAYLEKKAKTVNITGVNRTYLGIKKFKIKSGRQFQEEDYNQFSRVILLEEKLAQRLFQTNEAALNKVVTVKNKSYLVVGVYSDPEAGSGLYGSNSDGNAILTNTQLASEFGAKEAENIYFHLNDVSQSNRIGKEIGKRLTDISHAKDGYYDNFDMTSIVKSINTQVGIMTGVIGAIAAISLLVGGIGVMNIMLVSVTERTREIGLRKALGATRRKILAQFLIESMVLTILGGLIGLLLAYGGTMLIANAQDKITPSVSLNVAIGSLIFSAFIGIIFGLLPANKASKLNPIDALRYE

SEQ ID NO: 321 - protein, 404 aa, Streptococcus agalactiae
MQYSEIMIRYGELSTKKKNRMRFINKLKNNMEHVLSIYPDVSVKTDRDRGHVYLNGTDYHEVAESLKEIFGIQAFSPSFKVEKNVDTLVKAVQEIMTSVYKDGMTFKITAKRSDHSFELDSRALNHTLGDAVFSVLPNIKAQMKQPDINLKVEIRDEAAYISYENIRGAGGLPVGTSGKGMLMLSGGIDSPVAGYLALKRGVDIEAVHFASPPYTSPGALKKAHDLTRKLTKFGGNIQFIEVPFTEIQEEIKEKAPEAYLMTLTRRFMMRITDRIRENRNGLVIINGESLGQVASQTLESMQAINAVTATPIIRPVVTMDKLEIIDIAQKIDTFDISIQPFEDCCTIFAPDRPKTNPKIKNTEQYEKRMDVEGLVERAVAGIMVTTIQPQADSDDVDDLIDDLL

SEQ ID NO: 322 - protein, 119 aa, Streptococcus agalactiae
MARVKGGVVSRKRRKRVLKLAKGYYGAKHILFRTAKEQVMNSYYYAYRDRRQKKRDFRKLWITRINAAARMNGLSYSQLMHGLKLAEIEVNRKMLADLAVNDAAAFTALADAAKAKLGK

SEQ ID NO: 323 - protein, 341 aa, Streptococcus agalactiae
MFKASKKLVQKNKSNHFWLVFFITLILFLIGCYASLRFGAINFKTSDLITVLKNPLKNSNAQDVIFDIRLPRIIAAILVGAAMSQAGAIMQGVTRNAIADPGLLGINAGAGLALVVAYAFLGSMHYSTILIVCLLGSVISYLLVFTLSYTKQKGYHQLRLILAGAMISTLFTSVGQVVTLYFKLNRTVIGWQAGGLSQINWKMLIIIAPIIILGLLISQLLAHQLTILSLNESVAKALGQKTQLMTAFLLLIVLFLSASSVALIGTVSFIGLIIPHFIKLFIPKDYRLLLPLIGFSGATFMIWVDLSSRIINPPSETPISSIISIVGLPCFLWLIRKGKNL

SEQ ID NO: 324 - protein, 188 aa, Streptococcus agalactiae
MIKRPIHLSHDFLAEVIDKEAITLDATMGNGNDTVFLAKSSKKVYAFDIQEEAIAKTKAKLTEQGISNAELILDGHENLEQYVHTPLRAAIFNLGYLPSADKTVITKPHTTIKAIKNVLDILEVGGRLSLMVYYGHDGGKSEKDAVIAFVEQLPQNNFATMLYQPLNQVNTPPFLIMVEKLQSYENEV

SEQ ID NO: 325 - protein, 335 aa, Streptococcus agalactiae
MRVHITSIYGQSPRSIALISQKLVKDVGRQLGYDEMGIYFYNDHAETHGERSTRMDGIIAGLGRGDIVVFQVPTWNSTEFDELFLDKLQAYGARIITFVHDIVPLMFESNFYLLDRVIDMYNRSDVVILPTKAMHDYLIEKGMTTSKVLYQEVWDHPVNIDLPRPECQKVLSFAGDIQRFPFVNDWKENIPLIYYGDGSRLNSEANVHAQGWKDDVELMLSLSKRGGFGLCWSEDREELVERRYSRMNASYKLSTFLAAGLPIIANHDISSRDFIKQHGLGFTVETLEEAVEKINNMEKETYDSYVENVEKIATLLRNGYITKKLLIDAVHMLYR

SEQ ID NO: 326 - protein, 1310 aa, Streptococcus agalactiae
MSQKTFGKQLTVVDTKSRVKMHKSGKNWVRTVMSHFNLFKAIKGRATVEADVCIQDVEKEDRLSSGNLTYLKGILAAGALVGGASLTSRVYADETPVVQEQSSSVPTLAEQTEVTVKTTTVQNHQDGTVSKNIIDSNSVSMSESASTSTSESVSMSMSGSTLTSVSESVSTSALTSASESISTSASESVSKSTSISEVSNILETQASLTDKGRESFSANQIVTESSLVTDAGKNASVSSLIEITKPKSELQTSKMSNESLITPEKSQVMIASDKTGNESLTPTIRLKSVIQPRSMNLMTLSSEMDLIPLEEVSDTEMLGKDVSSELQKVNIALKDNTLSEPGTVKLDSSENLVLNFAFSIASVNEGDVFTVKLSDNLDTQGIGTILKVQDIMDETGQLLATGSYSPLTHNITYTWTRYASTLNNIKARVNMPVWPDQRIISKTTSDKQCFTATLNNQVASIEERVQYNSPSVTEHTNVKTNVRSRIMKLDDERQTETYITQINPEGKEMYFASGLGNLYTIIGSDGTSGSPVNLLNAEVKILKTNSKNLTDSMDQNYDSPEFEDVTSQYSYTNDGSKITIDWKTNSISSTTSYVVLVKIPKQSGVLYSTVSDINQTYGSKYSYGHTNISGDSDANAEIKLLSESASTSASTSASTSASMSASTSASTSASMSASTSASTSASMSASTSASTSASTSTSTSASTSASTSASTSASMSASTSASTSASTSASTSASTSASTSASTSASTSASTSASTSASTSASTSASTSASTSASTSASMSASMSASTSASMSASTSASTSASTSASTSASTSASTSASMSASTSASTSASTSASMSASTSASTSASTSASTSASTSTSTSASTSASTSASTSASMSASTSASTSPSTSASTSASTSASTSASTSASTSASMSASTSASTSASMSASTSASTSASTSASTSASMSASTSASTSASTSASMSASTSASTSASTSASTSASTSTSTSASTSASTSASTSASMSASTSASTSASTSASMSASTSASISASTSASMSASTSASTSASTSASTSASMSASTSASTSASTSASTSASMSASTSASTSASTSASTSASTSASTSASTSASTSSSTSASTSASTSASTSASMSASTSASTSASMSASTSASTSASTSASMSASTSSSTSASMSASTSASMSASTSASTSASTSASMSASTSSSTSASMSASTSASMSASTSASTSASTSASMSASTSASMSATTSASTSVSTSASTSASTSASTSSSSSVTSNSSKEKVYSALPSTGDQDYSVTATALGLGLMTGATLLGRKKSKKDKD

SEQ ID NO: 327 - protein, 663 aa, Streptococcus agalactiae
MIDRKDTNRFKLVSKYSPSGDQPQAIETLVDNIEGGEKAQILKGATGTGKTYTMSQVIAQVNKPTLVIAHNKTLAGQLYGEFKEFFPDNAVEYFVSYYDYYQPEAYVPSSDTYIEKDSSVNDEIDKLRHSATSSLLERNDVIVVASVSCIYGLGSPKEYADSVVSLRPGQEISRDQLLNNLVDIQFERNDIDFQRGKFRVRGDVVEVFPASRDEHAFRIEFFGDEIDRIREIESLTGRVLGEVEHLAIFPATHFMTNDEHMEEAISKIQAEMENQVELFEKEGKLIEAQRIRQRTEYDIEMLREMGYTNGVENYSRHMDGRSEGEPPFTLLDFFPEDFLIMIDESHMTMGQIKGMYNGDRSRKEMLVNYGFRLPSALDNRPLRREEFESHVHQIVYVSATPGDYEMEQTDTVVEQIIRPTGLLDPEVEVRPSMGQMDDLLGEINLRTEKGERTFITTLTKRMAEDLTDYLKEMGVKVKYMHSDIKTLERTEIIRDLRLGVFDVLIGINLLREGIDVPEVSLVAILDADKEGFLRNERGLIQTIGRAARNSNGHVIMYADKITDSMQRAMDETARRRRLQMDYNEKHGIVPQTIKKEIRDLIAITKSNDSDKPEKVVDYSSLSKKERQAEIKALQQQMQEAAELLDFELAAQIRDVILELKAID

SEQ ID NO: 328 - protein, 727 aa, Streptococcus agalactiae
MKHKLKAFTLALLSIFFVFGGKVSAETVNIVSDTAYAPFEFKDSDQTYKGIDVDIVNEVAKRAGWNVNMTYPGFDAAVNAVQSGQADALMAGTTVTEARKKVFNFSDTYYDTSVILYTKNNNKVTNYKQLKGKVVGVKNGTAAQSFLEENKSKYGYKVKTFDTSDLMNNSLDSGSIYAAMDDQPVVQFAINQGKAYAINMEGEAVGSFAFAVKKGSGHDNLIKEFNTAFAQMKSDGTYNDIMDKWLGKDATKTSGKATGNANEKATPVKPSYKIVSDSSFAPFEYQNGKGKYTGFDMELIKKIAKQQGFKLDISNPGFDAALNAVQSGQADGVIAGATITEARQKIFDFSDPYYTSSVILAVKKGSNVKSYQDLKGKTVGAKNGTASYTWLSDHADKYNYHVKAFDEASTMYDSMNSGSIDALMDDEAVLAYAINQGRKFETPIKGEKSGDIGFAVKKGANPELIKMFNNGLASLKKSGEYDKLVKKYLSTASTSSNDKAAKPVDESTILGLISNNYKQLLSGIGTTLSLTLISFAIAMVIGIIFGMMSVSPSNTLRTISMIFVDIVRGIPLMIVAAFIFWGIPNLIESITGHQSPINDFVAATIALSLNGGAYIAEIVRGGIEAVPSGQMEASRSLGISYGKTMQKVILPQAVRLMLPNFINQFVISLKDTTIVSAIGLVELFQTGKIIIARNYQSFRMYAILAIMYLVIITLLTRLAKRLEKRLK

SEQ ID NO: 329 - protein, 52 aa, Streptococcus agalactiae
MGDKPISFRDKDGNFVSAADVWNAEKLEELFNTLNPNRKLRLEREKLAKEKG

SEQ ID NO: 330 - protein, 280 aa, Streptococcus agalactiae
METYTLSNTLNIPKIGFGTWQLTEGEEAYKAVTHALKVGYTHIDTAQIYGNEHSVGRAIRDSGLARESIFLTTKIWNDKHDYHLAKASIDESLQKLGVDYIDLLLIHWPNPKALRENDAWKAGNAGTWKAMEEAYKEGKVKAIGVSNFMKHHLEALFETAEIKPMVNQIILAPGCAQEDLVRFCKGNDILLEAYSPFGTGAIFENESIKAIAEKYGKSVAQVALRWSLDNGFLPLPKSATPKNIEANLDIFDFQLNEDDITTLIQLDSGIKPKDPDNVSF

SEQ ID NO: 331 - protein, 155 aa, Streptococcus agalactiae
MVKGQGNVVAQNKKAHHDYTIVETIEAGIVLTGTEIKSVRAARITLKDGYAQIKNGEAWLINVHITPYDQGNIWNQDPDRTRKLLLKKREIEKISNELKGTGMTLVPLKVYLKDGFAKVLLGLAKGKHDYDKRESIKRREQNRDIARQLKNYNSR

SEQ ID NO: 332 - protein, 267 aa, Streptococcus agalactiae
MDHFTKLWQDFSKLPNVVAIALGGSRSGDSFDQSSDYDLYVYCAATPDITSRKRILNKHCHYIELNNHYWELEDNGTLNDGTDIDILYRNIDNFLSDLEDVVEHHNSRIGYTTCFWHNLINCQILYDPENQLQSLKERFEVSYPSQLQKQIIIQNRNLLTGKLPSYDKQIIKALKRQDFVSTHHRTTAFLDSYFDIIFALNKLTHPGEKRMISYAKKNATLLPKHFEENIIKLCHHNSNEHTVKETLNDIIMHLDVMLKENFQHFIG

SEQ ID NO: 333 - protein, 267 aa, Streptococcus agalactiae
MKKIIYLGLACVSILTLSGCESIERSLKGDRYVDQKLAENSSKEATEQLNKKTKQALKADKKAFPQLDKAVAKNEAQVLIKTSKGDINIKLFPKYAPLAVENFLTHAKEGYYNGLSFHRVIKDFMIQSGDPNGDGTGGKSIWNSKDKKKDSGNGFVNEISPYLYNIRGSLAMANAGADTNGSQFFINQSQQDHSKQLSDKKVPKVIIKAYSEGGNPSLDGGYTVFGQVISGMETVDKIASVEVTKSDQPKEKITITSIKVIKDYKFK

SEQ ID NO: 334 - protein, 229 aa, Streptococcus agalactiae
MKIGIIAAMEEELKLLVENLEDKSQETVLSNVYYSGRYGEHELVLVQSGVGKVMSAMSVAILVESFKVDAIINTGSAGAVATGLNVGDVVVADTLVYHDVDLTAFGYDYGQMSMQPLYFHSDKTFVSTFEAVLSKEEMTSKVGLIATGDSFIAGQEKIDVIKGHFPQVLAVEMEGAAIAQAAQATGKPFVVVRAMSDTAAHDANITFDEFIIEAGKRSAQVLMAFLKAL

SEQ ID NO: 335 - protein, 388 aa, Streptococcus agalactiae
MEKRLSLGALVLASTVLLAACGNVGGGASSTGTKIGKDIKVGYNWELSGNVSSYGNSMKNGADLAVKEINAAGGVGGKKLKVLSQDNKSENAEAATVATNLVTKGANVIIGPATSGAAASSTPKVNAAAVPMIAPAATQDNLVYGSDGKTLNQYFFRATFVDNYQGKLLSQYATDNLKAKKVVLFYDNSSDYSKGVAKSFKESYSGKIVDSMTFSAGDTDFQASLTKLKGKEYDAIVMPGYYTETGLIVKQARDLGISKPVLGPDGFDSPKFVQSATPVGASNVYYLTGFTTQGSTKAKAFHDHYVKAYGEEPSMFSALSYDAVYMAAKSAKGAKTSIDLKKALAKLKDFKGVTGKMSIDKNHNVVKSAYVVKLDDGKTSSVNIISAK

SEQ ID NO: 336 - protein, 450 aa, Streptococcus agalactiae
MENHNSIKQTYGLMTTIAMIVGVVIGSGIYFKVDDILKFTGGDVFLGMVILVLGSFSIVFGSLSISELAIRTSESGGIFSYYEKYVSPALAATLGLFASFLYLPTLTAIVSWVAAFYTLGESSSLESQIILAAVYILALSLMNIFAKRIAGGFQSLTTFVKMIPLVLIALIGAFWSDKAPQLPQHLTAIQPSNVGWSWVSGLVPLYFAYDGWTIFVSIAPEVKNPKKNLPLAFVIGPALILLSYLAFFYGLTQILGASFIMTTGNDAINYAANIIFGPSVGRLLSFIVILSVLGVANGLLLGTMRLPQAFAERGWIKSERMANINLKYQMSLPASLTVTAVAIFWLFVHFMVTKFNLLPGSDISEIAVVFNNTSLIILYVLVLSLYLKKDIKNKFTGLVSPILAILGGLILFIGSLLSNFFTVLIFQCFCLLFCLICHYIYQKNNPKTHE

SEQ ID NO: 337 - protein, 600 aa, Streptococcus agalactiae
LTEFNDDQHSNHDQKSFKEQILAELEEANRLRKLREEELYQKEQEAKEAARRTAQLMADYEAQRLKDEQEARAKALETKQRLEEQEKARIEAKLLAEAAREEERRQAEQALASQEEQVINQGMEPSRELDSGSKSSEFRTTENVPDIDLKADKTDVATAVPNQETEEIFLVRATDIPTEGENVKLGETSELEPVAKEPIRVEDLSKEEEDIALSAKNKHNKRERRQKADNVAKRIARILISIIILVLLLTAFVGYRFVDSAIKPVDSNSNKFVQVEIPIGSGNKLIGQILEKAGVIKSATVFNYYSKFKNYSNFQSGYYNLKKSMTLDQIAAELEKGGTAEPTKPALGKILITEGYTIKQIAKAIESNKIDTKTTSTPYKADDFLKLVQDETFIKKMVAKYPNLLGSLPDKSKAIYQLEGYLFPATYNYYKDTTLEGLVEDMISTMNTKMAPYYNTIKAKNMSVNDVLTLSSLVEKEGSTDEDRRKIASVFYNRLSAGQALQSNIAILYAMGKLGDKTSLAEDAQINTSIKSPYNIYTNTGLMPGPVDSPSISAIEATIKPASTDYLYFVADVKTGNVYYAKDFETHKANVEKYINSQIN

SEQ ID NO: 338 - protein, 1032 aa, Streptococcus agalactiae
MSRMIPGRIRNQGIELYEQGLVSLISQEGNLLKAKVGDCQIEYSLVTEETKCSCDFFARKGYCQHLAALEHFLKNDPEGKAILSKVQVQQESQQETKKKTSFGSVFLDSLIINEDDTIKYQLSAQGEQNPYANDIWWTLKIRRLPDDRSYVIRDIKAFLNTVRKEAYYQIGKQYFETLSLIQFDETSQELIEFLWRLIPSHSSKIDLEFILPNQGRHLSLTRGFFEEGVTLMNALENFSFESDFHQFNHLYFKELEGEDHLYQFKVIVHRQSIELEIKEKDLKPLFANSYLFYRDTFYHLNLKQEKMVTAIRSLPIEGDLAKHIHFDLDDQDKLAAHLLDFKEIGLVDAPRSFSIHDFKVNFEFDINSQNEILLQMVFDYGNDLTVHNRQELEQLTFASHFKHEEKIFKLLERYGFAPHFSTSHPAYSAQELYDFYTYMLPQFKKMGTVSLSAKLESYRLIERPQIDIEAKGSLLDISFDFSDLLENDVDQALVALFDNNPYFVNKSGQLVIFDEETKKVSATLQGLRARRAKNGHIELDNIAAFQLSELFANQDNVSFSQHFYQLIEDLRHPEKFKIPGLSVSASLRDYQLTGVRWLSMLDHYGFAGILADDMGLGKTLQTISFLSTKLTRDSRVLILSPSSLIYNWQDEFHKFAPDVDVAVAYGSKIRRDEIIAERHQVIITSYSSFRQDFETYSEGNYDYLILDEAQVMKNAQTKIAHSLRSFEVKNCFALSGTPIENKLLEIWSIFQIILPGLLPGKKEFLKLNPKQVARYIKPFVMRRRKEEVLPELPDLIEMNYPNEMTDSQKVIYLAQLRQIQESIQHSSDADLNRRKIEILSGITRLRQICDTPRLFMDYDGESGKLESLHQLLTQIKENGHRALIFSQFRGMLDIAEREMVAMGLTTYKITGSTPANERHEMTRAFNAGSKDAFLISLKAGGVGLNLTGADTVVLIDLWWNPAVEMQAISRAHRLGQKENVEVYRLITRGTIEEKILEMQETKKHLVTTVLDGNETHASMSVDDIREILGVSK

SEQ ID NO: 339 - protein, 177 aa, Streptococcus agalactiae
VLLTEIKKSPEGLYFDKKIDIKESLMERHSEIMDISDIQVSGHVVYEDGLYLLDYNMAYDITLPSSRSMKPVVLSEKQTINEVFIEAENVSTKKELVDQDLVLILEEDDINLEESVIDNILLNIPLRVLAADEVGVEADLSGKNWSLMTEKQYEEKQAKEKEKSNPFAALEGMFDSD

SEQ ID NO: 340 - protein, 192 aa, Streptococcus agalactiae
MEVKTAIEWMHTFNQKIQSNKDYLSELDTPIGDGDHGGNMARGMTAVIENLDNNEFSSAADVFKTVSMQLLSKVGGASGPLYGSAFMGITKAEQSESTISEALGAGLEMIQKRGKAELNEKTMVDVWHGVIEAIEKNELTEDRIDSLVDATKGMKATKGRASYVGERSLGHIDPGSFSSGLLFKALLEVGGV

SEQ ID NO: 341 - protein, 942 aa, Streptococcus agalactiae
MQDKLMIRGARAHNLKNISVDIPRDKLVVVTGLSGSGKSSLAFDTIYAEGQRRYVESLSAYARQFLGNMEKPDVDSIDGLSPAISIDQKTTSKNPRSTVGTVTEINDYLRLLYARVGTPYCINGHGAITASSVEQIVDKVLALPERTKMQILAPIIRRKKGQHKSTFEKIQKDGYVRVRIDGDIHDVTEVPELSKSKMHNIDIVVDRLINKEGIRSRLFDSVEAALRLSDGYVVIDTMDGNELLFSEHYSCPECGFTVPELEPRLFSFNAPFGSCTTCDGLGIKLEVDIDLVIPDKSKTLREGALVPWNPISSNYYPTMLEQAMTQFDVDMDTPFEKLSKAEQDLALYGSGEREFHFHYINDFGGERNIDLPFEGVVNNINRRYHETNSDYTRNVMREYMNELKCNTCHGYRLNDQALCVRVGGEEGLNIGQVSDLSIADHLELLETLRLSSNEQLIARPIIKEIHDRLSFLNNVGLNYLNLSRSAGTLSGGESQRIRLATQIGSNLSGVLYVLDEPSIGLHQRDNDRLIDSLKKMRDLGNTLIVVEHDEDTMMAADWLIDVGPGAGAFGGEIVASGTPKQVAKNTKSITGQYLSGKKVIPVPSERRVGNGRFLEIKGAAENNLQNLDVKFPLGKFIAVTGVSGSGKSTLINSILKKAVAQKLNRNSDKPGKYVSLEGIEYVDRLIDIDQSPIGRTPRSNPATYTGVFDDIRDLFAQTNEAKIRGYKKGRFSFNVKGGRCESCSGDGIIKIEMHFLPDVYVPCEVCHGTRYNSETLEVHYKEKNIAQILDMTVNDAVTFFAAIPKIARKLQTIKDVGLGYVTLGQPATTLSGGEAQRMKLASELHKRSTGKSLYILDEPTTGLHADDIARLLKVLDRFVDDGNTVLVIEHNLDVIKTADHIIDLGPEGGIGGGQIVAIGTPEEVAENPKSYTGYYLKEKLAR

SEQ ID NO: 342 - protein, 374 aa, Streptococcus agalactiae
MWPEDRIASFRRTLLGWYDQEKRDLPWRRTTNPYYIWVSEIMLQQTQVNTVIPYYKRFLEWFPQIKDLADAPEEQLLKAWEGLGYYSRVRNMQKAAQQVMVDFGGIFPHTYDDIASLKGIGPYTAGAIASISFNLPEPAVDGNVMRVMARLFEVNYDIGDPKNRKIFQAIMEILIDPDRPGDFNQALMDLGTDIESAKTPRPDESPIRFFNAAYLNGTYSKYPIKNPKKKPKPMRIQAFVIRNQNGQYLLEKNTKGRLLGGFWSFPIIETSPLSQQLDLFDDNQSNPIIWQTQNETFQREYQLKPQWTDNHFPNIKHTFSHQKWTIELIEGVVKATDLPNAPHLKWAAIEDFSLYPFATPQKKMLETYLKQKNA

SEQ ID NO: 343 - protein, 282 aa, Streptococcus agalactiae
LIEITWTVKYITEFIATAFLIILGNGAVANVDLKGTKGNNSGWIIIAIGYGLGVMMPALMFGNVSGNHINPAFTLGLAFSGLFPWAHVGQYILAQILGAMFGQLVVVMVYQPYFVKTENPNHVLGSFSTISALDDGQKSSRKAAYINGFLNEFVGSFVLFFGALALTKNYFGVELVGKLVQAGYDQTTAATRISPYVTGSLAVAHLGIGFLVMTLVASLGGPTGPALNPARDLGPRIVHRLLPKQILGQAKEDSKWWYAWVPVLAPIVASILAVALFKLLYL

SEQ ID NO: 344 - protein, 326 aa, Streptococcus agalactiae
MSSYWNNYPELKKNIDETNQLIQERIQVRNKDIEAALSQLTAAGGKQLRPAFFYLFSQLGNKENQDTQQLKKIAASLEILHVATLIHDDVIDDSPLRRGNMTIQSKFGKDIAVYTGDLLFTVFFDLILESMADTPFMRINAKSMRKILMGELDQMHLRYNQQQGIHHYLRAISGKTAELFKLASKEGAYFGGAEKEVVRLAGHIGFNIGMTFQILDDILDYTADKKTFNKPVLEDLTQGVYSLPLLLAIEENPDIFKPILDKKTDMATEDMEKIAYLVVSHRGVDKARHLARKFTEKAISDINKLPQNSAKKQLLQLTNYLLKRKI

SEQ ID NO: 345 - protein, 582 aa, Streptococcus agalactiae
MFKIPLFKELKTDQWVKPFFKQYKVSLVIALFLGFMTFFSASALMFNSGYLISKSASLPSNILLVYVPIVLTRAFGIGRPVFRYIERLTSHNWVLRMTSQLRLKLYHSLESNAIFMKRDFRLGDVMGLLAEDINYLQNLYLRTIFPTIIAWLLYSFIIIATGFFSLWFALMMLLYLAIMIFLFPLWSILANGARQTREKELKNHLYTDLTDNVLGISDWIFSQRGQEYVALHERSESELMAIQKKIRSFNNRRALIVELVFGFLAILVIIWASNQFIGHRGGEANWIAAFVLTVFPLSEAFAGLSAAAQETNKYSDSIHRLNELSETYFETTQNQLPNKPYDFSVKNLSFQYKPQEKWVLHHLDLDIKEGEKIAILGRSGSGKSTLASLLRGDLKASQGKITLGGADVSIVGDCISNYIGVIQQAPYLFNTTLLNNIRIGNQDASEEDVWKVLERVGLKEMVTDLSDGLYTMVDEAGLRFSGGERHRIALARILLKDVPIVILDEPTVGLDPITEQALLRVFMKELEGKTLVWITHHLKGIEHADRILFIENGQLELEGSPQELSQSSQRYRQLKAADDGDL

SEQ ID NO: 346 - protein, 148 aa, Streptococcus agalactiae
MKKLITEKKVNNVSTVNYLKLGLVSAMFAGGAFVALGSTQGVSASTFTAPQATHPKAERQLTDSEIYERAQKQVLPKYIQGSLSGILNQHSTLYKQQNAAVTPQVSSPKAERQLTDSEIYERAQKQVLPKYIQGSLSGILNQHSTLNA

SEQ ID NO: 347 - protein, 169 aa, Streptococcus agalactiae
MEENMNIKQLKSKTMLGTVALVSAFSFASTNADANTYNYAVDVDYLASAEEIAQAHPASNTFPLGQCTWGVKEMATWAGNWWGNGGDWAASAASAGYTVGTQPRVGSIVCWTDGSYGHVAYVTAVDPVTNKIQVLESNYAGHQWIDNYRGWFDPQNTATPGVVSYIYPN

SEQ ID NO: 348 - protein, 313 aa, Streptococcus agalactiae
MKINQMKKDELFEGFYLIKKAEVRKTRAGKDFIAFTFRDDTGEISGNMWDAQTYNVEEFVAGKIVHMKGRREVYNGTPQVNQITLRNIKDGEPNDPRDFKEKPPINVDNVREYMEQMLFKIENATWQRVVRALYRKYNKEFFTYPAAKTNHHAFESGLAYHTATMVRLADSIGDIYPELNKSLMFAGIMLHDLAKVIELSGPDNTEYTIRGNLIGHISLIDEELTKILAELNIDDTKEEVTVLRHVILSHHGQLEYGSPVRPRIMEAEIIHMIDNIDANMMMMTTALNRVNEGEMTNRIFAMDNRSFYKPNIK

SEQ ID NO: 349 - protein, 283 aa, Streptococcus agalactiae
MLVDKKWRFEDSASYFACPKCQNPLIKESNSLKCSDNHCFDLSKFGYVNLLGGKKIDEHYDKKSFENRQLVLENGYYNHILEAISKVLENNSQFHSVLDIGCGEGFYSRQLVNKYEKTFLAFDISKDSIQLAAKSDQSRLVKWFVSDLANLPIQDSSIDIILDIFSPANYKEFRRVLSDDGILVKVVPVAEHVQELREKASQYLKQKDYSNQKILDHFRENFEIISEQKVVQSYNCSQQERQAFIDMTPLLFSVDKTTIDWASISEITVGALIVIGKKRSVSK

SEQ ID NO: 350 - protein, 149 aa, Streptococcus agalactiae
MCLICQRIEMIERNENPYFVKEYETGYLVLGDHQYFQGYCLFLSKKHVTELHELPRDWRNQYLSEMADASEIVAKAFRADKMNIESLGNGDAHLHFHLFPRKTGDLRNYGHNGKGPVWWYPFEKMYADSVRATGAEIEKLKEKLLDVLG

SEQ ID NO: 351 - protein, 395 aa, Streptococcus agalactiae
MFSDLRKKFVFLTMSILIVVVLFLFAVSNRYNQYWDEYDAYRIVKLVAKNDYLGIPGDEPIALVTIDNQKMVKIQSNNTDLTNDVIEKSSLKLLEQGKKSRKWKSFIYSIKEYKDKTYTIAIMDLASYEVPYARRFLILVFTIFGFCLLAAVSLYLSRFIVGPVETEMTREKQFVSDASHELKTPIAAIRANVQVLEQQIPGNRYLDHVVSETKRMEFLIEDLLNLSRLDEKRSKVNFKKLNLSVLCQEVLLTYESLAYEEEKCLNDTIEDDVWIVGEESQIKQILIILLDNAIRHSLSKSEIQFSLKQARRKAILTISNPSAIYSKEVMDNLFERFYQAKDDHADSLSFGLGLSIAKAIVERHKGRIRAYQEKDQLRLEVQLPIDGFWTNTMIN

SEQ ID NO: 352 - protein, 559 aa, Streptococcus agalactiae
LIILDKKSYDLLFYLLKLEEPETVMAIANALNQSRRKVYYHLEKINDALPSDVPQIVSYPRVGILLTEKQKAACRLLLDEVTDYSYVMKSSERLQLSLVSIVVAKDRITIDRLMQLNDVSRNTILNDLNELRSELAEKEYNLQLQSTKCRGYFLDGHPLSIIQYLYKLLDDIYHNGSSSFIDLFNHKLSQAFGASTYFSKEVLDYFHHYLFISQRSLGKKINSQDGQFMIQILPFILMAYRKMRLSPEVQTSLNSDFSLVWQRKEYEIAKELADELEENFQLSLDEIEVGLVAMLMLSFRKDRDNHLESQDYDDMRATLTSFLKELEERYHLHFVHKKDLLRQLLTHCKALLYRKRYGIFSVNPLTEHIKDKYEELFAITSSSVKLLEKAWQIKLTDDDVAYLTIHLGGELRNSQQSPNKLKLVIVSDEGIAIQKLLLKQCQRYLTNSDIEAVFTTEQYQSVSDLMHVDMVVSTSDALESRFPMLVVHPVLTDDDIIRLIRFSKKGNCANSNQFTNELEKTIAQYVKEDSERYVLKSKIEKLIHQELLQDVLPLQSTVC

SEQ ID NO: 353 - protein, 215 aa, Streptococcus agalactiae
MKYFLDTADVSEIRRLNRLGIVDGVTTNPTIISREGRDFKEVINEICQIVDGPVSAEVTGLTCDEMVTEAREIAKWSPNVVVKIPMTEEGLAAVSQLSKEGIKTNVTLIFTVAQGLSAMKAGATFISPFVGRLEDIGTDAYALIRDLRHIIDFYGFQSEIIAASIRGLAHVEGVAKCGAHIATIPDKTFASLFTHPLTDKGIETFLKDWDSFKKK

SEQ ID NO: 354 - protein, 815 aa, Streptococcus agalactiae
MSHYSIKLQEVFRLAQFQAARYESHYLESWHLLLAMVLVHDSVAGLTFAEYESEVAIEEYEAATILALGRAPKEEITNYQFLEQSPALKKILKLAENISIVVGAEDVGTEHVLLAMLVNKDLLATRILELVGFRGQDDGESVRMVDLRKALERHAGFTKDDIKAIYELRNPKKAKSGASFSDMMKPPSTAGDLADFTRDLSQMAVDGEIEPVIGRDKEISRMVQVLSRKTKNNPVLVGDAGVGKTALAYGLAQRIANGNIPYELRDMRVLELDMMSVVAGTRFRGDFEERMNQIIADIEEDGHIILFIDELHTIMGSGSGIDSTLDAANILKPALARGTLRTVGATTQEEYQKHIEKDAALSRRFAKVLVEEPNLEDAYEILLGLKPAYEAFHNVTISDEAVMTAVKVAHRYLTSKNLPDSAIDLLDEASATVQMMIKKNAPSLLTEVDQAILDDDMKSASKALKASYKGKKRKPIAVTEDHIMATLSRLSGIPVEKLTQADSKKYLNLEKELHKRVIGQDDAVTAISRAIRRNQSGIRTGKRPIGSFMFLGPTGVGKTELAKALAEVLFDDESALIRFDMSEYMEKFAASHLNGAPPGYVGYDEGGELTEKVRNKPYSVLLFDEVEKAHPDIFNVLLQVLDDGVLTDSRGRKVDFSNTIIIMTSNLGATALRDDKTVGFGAKDISHDYTAMQKRIMEELKKAYRPEFINRIDEKVVFHSLSQDNMREVVKIMVKPLILALKDKGMDLKFQPSALKHLAEDGYDIEMGARPLRRTIQTQVEDHLSELLLANQVKEGQVIKIGVSKGKLKFDIAKS

SEQ ID NO: 355 - protein, 510 aa, Streptococcus agalactiae
MVLDKEIKAQLAQYLDLLESDIVLQADLGDNDNSQKVKDFLDEIVAMSDRISLESTHLKRQPSFGIAKKGHESRVIFSGLPMGHEFTSFILALLQVSGRAPKVDEDIIKRIKGIEKTINLETYVSLTCHNCPDVVQAFNIMAVLNPNITHTMIEGGMYQDEVKSKGIMSVPTVYKDQEEFTSGRATIEQLLEQLDGPLDAEAFADKGVYDVLVIGGGPAGNSAAIYAARKGLKTGILAETFGGQVIETVGIENMIGTLYTEGPKLMAQIEEHTKSYDIDIIKSQLATGIEKKELVEVTLANGAILQAKTAILALGAKWRNINVPGEEEFRNKGVTYCPHCDGPLFEGKDVAVIGGGNSGMEAALDLAGVTKHVTVLEFLPELKADQVLQERAAKTDNLTILKNVATKDIVGEDHVTGLNYTDRDTNEEKHIDLEGVFVQIGLVPSTSWLKDSGIELNERQEIVVDKFGSTNIPGIFAAGDCTDAAYKQIIISMGSGATAAIGAFDYLIRQ

SEQ ID NO: 356 - protein, 631 aa, Streptococcus agalactiae
MIKYQDDFYQAVNGEWAKTAVIPDDKPRTGGFSDLADDIEALMLSTTDKWLADENKPSDTILNHFIAFHKMTADYQKREEVGVSPVLPLIEEYKGLQSFSEFASKVAEYELEGKPNEFPFGVAPDFMNAQLNVLWAEAPGIILPDTTYYSEDNEKGKELLAFWRKSQEDLLPLFGLSEQEIKDILDKVLALDAKLAQYVLSREESSEYVKLYHPYNWEDFTKLAPELPLDAIFQKILGQKPDKVIVPEERFWTEFASDYYSESNWELLKADLILSAANAYNAYLTDDIRIKSGVYSRALSGTPQAMDKKKAAYYLASGPYNQALGLWYAGEKFSPEAKADVEHKIATMIDVYKSRLEKADWLAQSTREKAIMKLNVITPHIGYPEKLPETYTKKIIDPKLSLVENATNLDKISIAYGWSKWNKPVDRSEWHMPAHMVNAYYDPQQNQIVFPAAILQEPFYALEQSSSANYGGIGAVIAHEISHAFDTNGASFDEHGSLNNWWTDEDFEAFKKLTDKVVEQFDGLESYGAKVNGKLTVSENVADLGGVACALEAAQRESDFSARDFFINFATIWRMKARDEYMQMLASVDVHAPAQWRTNITVTNFEEFHKEFDVKDGDNMWRPVEKRVIIW

SEQ ID NO: 357 - protein, 335 aa, Streptococcus agalactiae
MSKILFFGEPLIRITPKENDYFADSISTKLFYGGSEVNTARALQGFGQDTKLLSALPNNPIGNSFLQFLKAQGIDTHSIQWVGERVGLYFLEDSFACRKGEVVYDRDHSSLHDFRINQIDFDQLFEGVSLFHFSGITLSLDESIQEITLLLLKEAKKREITISLDLNFRSKLISPKNAKILFSQFATFADICFGIEPLMVDSQDTTFFNRDEATIEDVKERMISLINHFDFQVIFHTKRLQDEWGRNHYQAYIANRKQEFVTSKEITTAVNQRIGSGDAFVAGALYQLLQHSDSKTVIDFAVASASLKCALEGDNMFETVTAVNKVLNQSKDIIR

SEQ ID NO: 358 - protein, 194 aa, Streptococcus agalactiae
MKSRKKDKLVLRLTTTLLVFGLGGVWFYNYKNDNVEPTVTSASDQTTTFIQTISPTAIEISKTYDLYASVLLAQAILESSSGQSDLSKAPNYNLFGIKGEYKGKSVQMPTLEDDGKGNMTQIQAPFRAYPNYSASLYDYAELVSSQKYASVWKSNTSSYKDATAALTGLYATDTAYASKLNQIIETYSLDAYDK

SEQ ID NO: 359 - protein, 445 aa, Streptococcus agalactiae
MADVKVVNNEDSRGQKQDLKAKLFHIKIGSVPLPVYVCLALLILLAGFLQKLPVNMLGGFAVILTMGWFLGTIGASIPGFKNFGGPAILSLLVPSILVFFNLINKNVLESTNMLMKQANFLYFYIACLVSGSILGMNRKMLIQGLLRMIFPMLLGMVCAMMVGTFVGVILGLEWRHTLFYIVTPVLAGGIGEGILPLSLGYSSITGVASEQLVAQLIPATIIGNFFAILCTALLNRLGEKKPHLSGQGQLVRLNKGEDMSDIIADHSGPIDVKKMGGGVLTACSLFIFGHLLQQLTGFPGPVLMIVAAAILKYINVIPRETQNGAKQLYKFISGNFTFPLMAGLGLLYIPLKDVVATLSIQYFIVVISVVFTVISVGFFVSRFLNMNPVEAGIISACQSGMGGTGDVAILSTADRMNLMPFAQVATRLGGAITVITMTAILRMLF

SEQ ID NO: 360 - protein, 412 aa, Streptococcus agalactiae
RGKKAGKYTTSDGYIFDAKDIKKDTGTGYVIPHMTHEHWVPKKDLSESELKAAQEFLSGKSEANQDKPKTGKTAQEIYEAIEPKAIVKPEDLLFGIAQATDYKNGTFVIPHKDHYHYVELKWFDEEKDLLADSDKTYSLEDYLATAKYYMMHPEKRPKVEGWGKDAEIYKEKDSNKADKPSPAPTDNKSTSNSSDKNLSAAEVFKQAKPEKIVPLDKIAAHMAYAVGFEDDQLIVPHHDHYHNVPMAWFDKGGLWKAPEGYTLQQLFSTIKYYMEHPNELPKEKGWGHDSDHNKGSNKDNKAKNYAPDEEPEDSGKVTHNYGFYDVNKGSDEEEPEKQEDESELDEYELGMAQNAKKYGMDRQSFEKQLIQLSNKYSVSFESFNYINGSQVQVTKKDGSKVLVDIKTLTEVK

SEQ ID NO: 361 - protein, 481 aa, Streptococcus agalactiae
MNRKKTVIISALSVALFGTGVGAYQLGSYNAQKSDNSVSYVKTDKSDSKAQATAVNKTPDQISKEEGISAEQIVVKITDDGYVTSHGDHYHYYNGKVPYDAIISEELIMKDPSYVFNKADVINEVKDGYIIKVNGKYYLYLKEGSKRTNVRTKEQIQKQREEWSKGGSKGESGKHSSAKTQALSASVREAKASGRYTTDDGYVFSPTDVIDDMGDAFLVPHGDHFHYIPKADLSPSELSAAQAYWNRKTGRSGNSSKPSNSSSYIHASAPSGNVSTGRHANAPISIPRVTHANHWSKPAGNHATAPKHHAPTTKPINKDSALDKMLKRLYAQPLYARHVESDGLVYDPAQVNAFTAIGVSIPHGNHFHFIHYKDMSPLELEATRMVAEHRGHHIDALGKKDSTEKPKHISHEPNKEPHTEEEHHAVTPKDQRKGKPNSQIVYSAQEIEEAKKLVNTQHLMVTFLMPKILKKIQVQVMSFHI

SEQ ID NO: 362 - protein, 156 aa, Streptococcus agalactiae
MAKFGFLSVLEEELDKHLQYDFAMDWDKKNHTVEVTFILEAQNSSAIETVDDQGETSSEDIVFEDYVLFYNPVKSRFDAEDYLVTIPYEPKKGLSREFLAYFAETLNEVATEGLSDLMDFLTDDSIEEFGLSWDTDAFENGRAELKETEFYPYPRY

SEQ ID NO: 363 - protein, 1570 aa, Streptococcus agalactiae
MNTKQRFSIRKYKLGAVSVLLGTLFFLGGITNVAADSVINKPSDIAVEQQVKDSPTSIANETPTNNTSSALASTAQDNLVTKANNSPTETQPVAESHSQATETFSPVANQPVESTQEVSKTPLTKQNLAVKSTPAISKETPQNIDSNKIITVPKVWNTGYKGEGTVVAIIDSGLDINHDALQLNDSTKAKYQNEQQMNAAKAKAGINYGKWYNNKVIFGHNYVDVNTELKEVKSTSHGMHVTSIATANPSKKDTNELIYGVAPEAQVMFMRVFSDEKRGTGPALYVKAIEDAVKLGADSINLSLGGANGSLVNADDRLIKALEMARLAGVSVVIAAGNDGTFGSGASKPSALYPDYGLVGSPSTAREAISVASYNNTTLVNKVFNIIGLENNRNLNNGLAAYADPKVSDKTFEVGKQYDYVFVGKGNDNDYKDKTLNGKIALIERGDITFTKKVVNAINHGAVGAIIFNNKAGEANLTMSLDPEASAIPAIFTQKEFGDVLAKNNYKIVFNNIKNKQANPNAGVLSDFSSWGLTADGQLKPDLSAPGGSIYAAINDNEYDMMSGTSMASPHVAGATALVKQYLLKEHPELKKGDIERTVKYLLMSTAKAHLNKDTGAYTSPRQQGAGIIDVAAAVQTGLYLTGGENNYGSVTLGNIKDKISFDVTVHNINKVAKDLHYTTYLNTDQVKDGFVTLAPQQLGTFTGKTIRIEPGQTQTITIDIDVSKYHDMLKKVMPNGYFLEGYVRFTDPVDGGEVLSIPYVGFKGEFQNLEVLEKSIYKLVANKEKGFYFQPKQTNEVPGSEDYTALMTTSSEPIYSTDGTSPIQLKALGSYKSIDGKWILQLDQKGQPHLAISPNDDQNQDAVAVKGVFLRNFNNLRAKVYRADDVNLQKPLWVSAPQAGDKNYYSGNTENPKSTFLYDTEWKGTTTDGIPLEDGKYKYVLTYYSDVPGSKPQQMVFDITLDRQAPTLTTATYDKDRRIFKARPAVEHGESGIFREQVCYLKKDKDGHYNSVLRQQGEDGILVEDNKVFIKQEKNGSFILPKEVNDFSHVYYTVEDYAGNLVSAKLEDLINIGNKNGLVNVKVFSPELNSNVDIDFSYSVKDDKGNIIKKQHHGKDLNLLKLPFGTYTFDLFLYDEERANLISPKSVTVTISEKDSLKDVLFKVNLLKKAALLVEFDKLLPKGATVQLVTKTNTVVDLPKATYSPTDYGKNIPVGDYRLNVTLPSGYSTLENLDDLLVSVKEDQVNLTKLTLINKAPLINALAEQTDIITQPVFYNAGTHLKNNYLANLEKAQTLIKNRVEQTSIDNAIAALRESRQALNGKETDTSLLAKAILAETEIKGNYQFVNASPLSQSTYINQVQLAKNLLQKPNVTQSEVDKALENLDIAKNQLNGHETDYSGLHHMIIKANVLKQTSSKYQNASQFAKENYNNLIKKAELLLSNRQATQAQVEELLNQIKATEQELDGRDRVSSAENYSQSLNDNDSLNTTPINPPNQPQALIFKKGMTKESEVAQKRVLGVTSQTDNQKVKTNKLPKTGESTPKITYTILLFSLSMLGLATIKLKSIKRE

SEQ ID NO: 364 - protein, 643 aa, Streptococcus agalactiae
MNNNEKKVKYFLRKTAYGLASMSAAFAVCSGIVHADTSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKMLDEVKKLLKELQDLTRGTKEDKKPDVKPEAKPEAKPNIQVPKQAPTEAAKPALSPEALTRLTTWYNQAKDLLKDDQVKDKYVDILAVQKAVDQAYDHVEEGKFITTDQANQLANKLRDALQSLELKDKKVAKPEAKPEAKPEAKPEAKPEAKPEAKPEAKPEAKPDVKPEAKPDVKPEAKPEAKPEAKSEAKPEAKLEAKPEAKPATKKSVNTSGNLAAKKAIENKKYSKKLPSTGEAASPLLAIVSLIVMLSAGLITIVLKHKKN

SEQ ID NO: 365 - protein, 540 aa, Streptococcus agalactiae
MAKDIKFSADARSAMVRGVDILADTVKVTLGPKGRNVVLEKAFGSPLITNDGVTIAKEIELEDHFENMGAKLVSEVASKTNDIAGDGTTTATVLTQAIVREGLKNVTAGANPIGIRRGIETAVSAAVEELKEIAQPVSGKEAIAQVAAVSSRSEKVGEYISEAMGRVGNDGVITIEESRGMETELEVVEGMQFDRGYLSQYMVTDNEKMVSELENPYILITDKKISNIQEILPLLEEVLKTNRPLLIIADDVDGEALPTLVLNKIRGTFNVVAVKAPGFGDRRKAMLEDIAILTGGTVVTEDLGLDLKDATMQVLGQSAKVTVDKDSTVIVEGAGDSSAIANRVAIIKSQMEATTSDFDREKLQERLAKLAGGVAVIKVGAATETELKEMKLRIEDALNATRAAVEEGIVSGGGTALVNVIEKVAALKLNGDEETGRNIVLRALEEPVRQIAYNAGYEGSVIIERLKQSEIGTGFNAANGEWVDMVTTGIIDPVKVTRSALQNAASVASLILTTEAVVANKPEPEAPTAPAMDPSMMGGF

SEQ ID NO: 366 - protein, 513 aa, Streptococcus agalactiae
VVENLEKPIGVSYKNSPSMSKRTAIRMKKSSRFSILLYSVLSTLLAIANPLLTYFANGLQTQNLYTGLMMTKGQIPYSDVFATGGFLYYVTIALSYLLGSSIWLLIVQFIAYYVSGIYFYKLVYYVAQSEIVSIGMTLIFYIMNIVLGFGGMYPIQWALPFMLISLWFLIKFCVDNIVDEAFIFYGILAAFSLFIDPQTLIFWLCSFVLLTATNIKQKQSLRGFYQFLCVVFGMILIAYTVGYFMFNLQIISSYIDKAIFYPFTYFARTNHSFLLSLAIQIVVLLGSGCLFGLWDFIQNRKKASYQIGLNFIACIFIIYAIMAIFSRDFNLYHFLPALPFGLLLTSNKITILYQKVIDRRSHRRQYFSGKSLIVDLFVKKTYYLPLLLVSLSIGLLVYNTYQNVTLSKERRDISHYLTTKIDRDGKIYVWDKVASIYSQTRLKSASQFVLPHINTAQKNNEKILKDELLQHGAKYFILNKNEKLPNELKSDIKKHYQEVPLSNITHFVLYRFK

SEQ ID NO: 367 - protein, 858 aa, Streptococcus agalactiae
MAKPTISPGMQQYLDIKENYPDAFLLFRMGDFYELFYDDAVKAAQILEISLTSRNKNAEKPIPMAGVPYHSAQQYIDVLVELGYKVAIAEQMEDPKKAVGVVKREVVQVVTPGTVVESTKPDSANNFLVAIDSQDQQTFGLAYMDVSTGEFQATLLTDFESVRSEILNLKAREIVVGYQLTDEKNHLLTKQMNLLLSYEDERLNDIHLIDEQLTDLEISAAEKLLQYVHRTQKRELSHLQKVVHYEIKDYLQMSYATKNSLDLLENARTSKKHGSLYWLLDETKTAMGTRMLRTWIDRPLVSMNRIKERQDIIQVFLDYFFERNDLTESLKGVYDIERLASRVSFGKANPKDLLQLGQTLSQIPRIKMILQSFNQPELDIIVNKIDTMPELESLINTAIAPEAQATITEGNIIKSGFDKQLDNYRTVMREGTGWIADIEAKERAASGIGTLKIDYNKKDGYYFHVTNSNLSLVPEHFFRKATLKNSERYGTAELAKIEGEMLEAREQSSNLEYDIFMRVRAQVESYIKRLQELAKTIATVDVLQSLAVVAENYHYVRPKFNDQHQIKIKNGRHATVEKVMGVQEYIPNSIYFDSQTDIQLITGPNMSGKSTYMRQLALTVIMAQMGGFVSADEVDLPVFDAIFTRIGAADDLISGQSTFMVEMMEANQAVKRASDKSLILFDELGRGTATYDGMALAQSIIEYIHDRVRAKTMFATHYHELTDLSEQLTRLVNVHVATLERDGEVTFLHKIESGPADKSYGIHVAKIAGLPIDLLDRATDILSQLEADAVQLIVSPSQEAVTADLNEELDSEKQQGQLSLFEEPSNAGRVIEELEAIDIMNLTPMQAMNAIFDLKKLL

SEQ ID NO: 368 - protein, 290 aa, Streptococcus agalactiae
MLKLDLKTKIKEAILIAFGVALYTFGFVKFNMANHLAEGGISGVTLIIHALFGVNPALSSLLLNIPLFILGARILGKKSLLLTIYGTVLMSFFMWFWQQIPVTVPLKNDMMLVAVAAGILAGTGSGLVFRYGATTGGADIIGRIVEEKSGIKLGQTLLFIDAIVLTSSLVYINLQQMLYTLVASFVFSQVLTNVENGGYTVRGMIIITKESESAAATILHEINRGVTFLRGQGAYSGREHDVLYVALNPSEVRDVKEIMADLDPDAFISVINVDEVISSDFKIRRRNYDK

SEQ ID NO: 369 - protein, 583 aa, Streptococcus agalactiae
MKRSMYAGRVRSEHIGTSITLKGWVGRRRDLGGLIFIDLRDREGIMQLVINPEEVAASVMATAESLRSEFVIEVSGVVTAREQANDNLPTGEVELKVQELSVLNTSKTTPFEIKDGIEANDDTRMRYRYLDLRRPEMLENFKLRAKVTHSIRNYLDNLEFIDVETPMLTKSTPEGARDYLVPSRVNQGHFYALPQSPQITKQLLMNAGFDRYYQIVKCFRDEDLRGDRQPEFTQVDLETSFLSDQEIQDIVEGMIAKVMKDTKGLEVSLPFPRMAYDDAMNNYGSDKPDTRFDMLLQDLTEIVKEVDFKVFSEASVVKAIVVKDKADKYSRKNIDKLTEIAKQYGAKGLAWLKYVDNTISGPVAKFLTAIEGRLTEALQLENNDLILFVADSLEVANETLGALRTRIAKELELIDYSKFNFLWVVDWPMFEWSEEEGRYMSAHHPFTLPTAETAHELEGDLAKVRAVAYDIVLNGYELGGGSLRINQKDTQERMFKALGFSAESAQEQFGFLLEAMDYGFPPHGGLAIGLDRFVMLLAGKDNIREVIAFPKNNKASDPMTQAPSLVSEQQLEELSLTVESYEN

SEQ ID NO: 370 - protein, 151 aa, Streptococcus agalactiae
KEKGKLIKKKILENNTDIIPKIIEKSPQNLILTSNYNRVNIDKIKNIKNFDKGFELGFPLFEKGEILRKEGEITSAIELFDKARELGYFVPALYNSYAMAFRKIKNYDDEILILQEGIERFKKSTLSSNINPKTIDRWSTRISRAKDLKCK

SEQ ID NO: 371 - protein, 225 aa, Streptococcus agalactiae
LNVKKHHLAYGAITLVALFSCILAVMVIFKSSQVTTESLSKADKVRVAKKSKMTKATSKSKVEDVKQAPKPSQASNEAPKSSSQSTEANSQQQVTASEEAAVEQAVVTENTPATSQAQQAYAVTETTYRPAQHQTSGQVLSNGNTAGAIGSAAAAQMAAATGVPQSTWEHIIARESNGNPNVANASGASGLFQTMPGWGSTATVQDQVNSAIKAYRAQGLSAWGY

SEQ ID NO: 372 - protein, 493 aa, Streptococcus agalactiae
MSNWDTKFLKKGFTFDDVLLIPAESHVLPNEVDMKTKLADNLTLNIPIITAAMDTVTDSKMAIAIARAGGLGIIHKNMSIVDQAEEVRKVKRSENGVIIDPFFLTPDNTVSEAEELMQNYRISGVPIVETLENRKLVGIITNRDMRFISDYKQLISEHMTSQNLVTAPIGTDLETAERILHEHRIEKLPLVDDEGRLSGLITIKDIEKVIEFPKAAKDEFGRLLVAGAVGVTSDTFERAEALFEAGADAIVIDTAHGHSAGVLRKIAEIRAHFPNRTLIAGNIATAEGARALYDAGVDVVKVGIGPGSICTTRVVAGVGVPQITAIYDAAAVAREYGKTIIADGGIKYSGDIVKALAAGGNAVMLGSMFAGTDEAPGETEIFQGRKFKTYRGMGSIAAMKKGSSDRYFQGSVNEANKLVPEGIEGRVAYKGSVADIVFQMLGGIRSGMGYVGAANIKELHDNAQFVEMSGAGLKESHPHDVQITNEAPNYSVH

SEQ ID NO: 373 - protein, 859 aa, Streptococcus agalactiae
MTINHYKLRIPYYTISFLLPFIIIVCILFTKNIYWGSPTTILASDGFHQYVIFNQALRNILHGSNSLFYTFTSGLGLNFYALSSYYLGSFLSPIVYFFNLKNMPDAIYLLTICKIGLIGLSMFVTLCKRHCKVNRVLLLVISTCYSLMSFSISQIEINMWLDVFILIPLVVLGVDQLLWERKPILYFLSLTALFIQNYYFGFMTAIFTSLYFIVQITRNTDSKVAFKQFLHFTFLSLLAGMTSSIMILPTYFDLTTHGEKLTKVSKMFTENSWYMDLFAKNMIGAYDTTKFGSIPMIYVGLLPLLLSLLYFTIKEVPRRTRLAYGFLIIFVIASFYITPLDLFWQGMHAPNMFLHRYSWVLSVLICLLAAECLEYLDNISWKKILGVNLILVSGFIITFLFKKHYHYLNLELLLLTLTFLSAYIILTISFVSKQIPKLVFYPFLIGFVVLEMTLNTFYQLNSLNDEWIFPSRQGYAKYNHSISKLVRKTERNNSTFFRTERWLGQTGNDSMKYNYNGISQFSSIRNRSSSQVLDRLGFKSDGTNLNLRYQNNTLIADSLFGVKYNLTEYPFDKFGFIKKAQDKQTILYKNQFASQLAILTNQVYQDKPFTVNTLDNQTTLLNQLSGLKETYFEHLIPNSVSGQTTLNKQVFVKKNKQGNTEITYNITIPKNSQLYVSMPFINFNNEENKIVQISVNNGPFVPNTLDNAYSFFNIGSFAENSRIKVKFQFPHNDQVSFPIPHFYGLKLEAYQKAMTVINKRKVKVRTDHNKVIANYTSPNRSSLFFTIPYDRGWKAYQNNKEIKIFKAQKGFMKINIPKGKGKVTLIFIPYGFKFGVGLSITGIVLFTVYYFKFGKNKIG

SEQ ID NO: 374 - protein, 15 aa, Streptococcus agalactiae
WFMKHSVGKRHNLVT

SEQ ID NO: 375 - protein, 30 aa, Streptococcus agalactiae
MKDHLRCFLHYRSKNVGKNGTRLKGGKPND

SEQ ID NO: 376 - protein, 33 aa, Streptococcus agalactiae
DKQLFQCVQGFQIRNLNGKKHGIKLIFIKNVKH

SEQ ID NO: 377 - protein, 26 aa, Streptococcus agalactiae
NEEAIDGVSKLGKKITILGNNSYLSS

SEQ ID NO: 378 - protein, 31 aa, Streptococcus agalactiae
IKQWLLVMKKMTVLCLKLLEILLLCKTAILN

SEQ ID NO: 379 - protein, 19 aa, Streptococcus agalactiae
RRISNNLGVLKEATVIHAV

SEQ ID NO: 380 - protein, 36 aa, Streptococcus agalactiae
ELCLKLSNVKPIYMPWHFEQISLKKQVSRVYHALFE

SEQ ID NO: 381 - protein, 32 aa, Streptococcus agalactiae
RSCFSRCYPRFNRFRYHFLKPPWTRTNYCKRY

SEQ ID NO: 382 - protein, 19 aa, Streptococcus agalactiae
RWFGFRYDDGRKFSFTNLL

SEQ ID NO: 383 - protein, 22 aa, Streptococcus agalactiae
PLKSLSMTSRMKLLRLSQRKAM

SEQ ID NO: 384 - protein, 30 aa, Streptococcus agalactiae
RHLRKRQKQNHLMNLCFLCAVKKLKKDNLI

SEQ ID NO: 385 - protein, 30 aa, Streptococcus agalactiae
KLFIQPIQENMKQPIEIISNYYAKLGLMKI

SEQ ID NO: 386 - protein, 19 aa, Streptococcus agalactiae
YQTYSKKARKFGSVWLKPK

SEQ ID NO: 387 - protein, 28 aa, Streptococcus agalactiae
TLLFQILLLLSHLKKNIFLEWNMHATYN

SEQ ID NO: 388 - protein, 70 aa, Streptococcus agalactiae
KKFYEIILATKYHTSVFKWSLKLKNKLTNTKKISEASSGKLEIHLEQQLNSMPKVTLALILLVDKSNALL

SEQ ID NO: 389 - protein, 111 aa, Streptococcus agalactiae
LKQMFRRVLHLLFQVVLIAVRSLMKMVLKSSWDGVTCSLSLLMRIIQYDYKVPLFQMMMLKGSLVLSKTKPRLTMMMPLILEKYLKQITALVVAAEYLKVILFLKKPRDSF

SEQ ID NO: 390 - protein, 13 aa, Streptococcus agalactiae
GRKINFSRPSRFE

SEQ ID NO: 391 - protein, 27 aa, Streptococcus agalactiae
RVKYKKWEPLSISRSCYEKSSSTSSRI

SEQ ID NO: 392 - protein, 31 aa, Streptococcus agalactiae
TWSRCCIPRCYSWCKIRRSNQCFGRWTSSFG

SEQ ID NO: 393 - protein, 33 aa, Streptococcus agalactiae
KENFVQRLRSLLKAISKNIIIYSLVSLPLARHL

SEQ ID NO: 394 - protein, 59 aa, Streptococcus agalactiae
SIINIKLEIYDICPKTISNRESIHGYRKLLPRLLFGDYLSKTLFQGFTSNHPNCRPIRL

SEQ ID NO: 395 - protein, 16 aa, Streptococcus agalactiae
LSFRRSRRIGSSHSQI

SEQ ID NO: 396 - protein, 14 aa, Streptococcus agalactiae
FIFKDRFKMRHFTD

SEQ ID NO: 397 - protein, 74 aa, Streptococcus agalactiae
GLICACKAFISAILANLFCSSVIPIASCPENICAKPRTRFSSTSDIVLSPAKYIFKAPTVLSFIFRGTTIAEFN

SEQ ID NO: 398 - protein, 33 aa, Streptococcus agalactiae
SSSLDTHYKHRELFLVADSLGSLWLILLVAYFV

SEQ ID NO: 399 - protein, 25 aa, Streptococcus agalactiae
HLVPTQYHKQNLPLEYKRLNALVHK

SEQ ID NO: 400 - protein, 24 aa, Streptococcus agalactiae
AHLHEGYHKYPLKRRNLYEFLRKL

SEQ ID NO: 401 - protein, 23 aa, Streptococcus agalactiae
PLKELREHYIIPRKIRLQNFPHR

SEQ ID NO: 402 - protein, 21 aa, Streptococcus agalactiae
KYTIAGSRVTQRRPSFSVTKV

SEQ ID NO: 403 - protein, 19 aa, Streptococcus agalactiae
AAFSSPAAKNRAFITTRSS

SEQ ID NO: 404 - protein, 47 aa, Streptococcus agalactiae
SMVKQISFSDHLISRFEGLCLRRFSVRFRLRRSLSSVSNSTNNTSWL

SEQ ID NO: 405 - protein, 43 aa, Streptococcus agalactiae
YHVLSRYHLNPLHVLQALYAHQEYVIVLIIHQRELFYRGQRGQ

SEQ ID NO: 406 - protein, 18 aa, Streptococcus agalactiae
AQPSSTRISPKIDRFTPK

SEQ ID NO: 407 - protein, 38 aa, Streptococcus agalactiae
WNRTINYFLNNLQLVTNIKLPTRKIFQSQNKFLSFIKN

SEQ ID NO: 408 - protein, 12 aa, Streptococcus agalactiae
VQEGHKIFPLQR

SEQ ID NO: 409 - protein, 29 aa, Streptococcus agalactiae
QQSNNTANYSRPYKPWHKKKNGLSCRCFS

SEQ ID NO: 410 - protein, 83 aa, Streptococcus agalactiae
FFDDTKVNIHWLEMFAVCMCNIMWQCTNSSSLWENYFTLPIKATGSIDSRYKTTCCRFYITFNTGHLSSKEKIWVLTCSKGLV

SEQ ID NO: 411 - protein, 81 aa, Streptococcus agalactiae
VYSLRIATLELERNLIDKRRGKPTDSRSIEFLEVSLAILSCKNKLIPDIMLEKTFPLVSSEAKSEDLKFKSAISLNLENCS

SEQ ID NO: 412 - protein, 56 aa, Streptococcus agalactiae
GHSNGIKEGNGGIFPVFCIAITATRFRFTINGFCNRINPCLCHFIVTLLSCCNRKS

SEQ ID NO: 413 - protein, 163 aa, Streptococcus agalactiae
RIEKAIVPKPAISVLMIISRMVLGTPEKEPVICSANGIISIVIATPADIEIQMSKADIIKAKPVEKLFCENSLTELTKAAPGTITISAPNIIMLRCSPNPEKYNKLALKATTELPRMVKRNPVCIRLSIKFRKYPKIKPVTAAENESNKELPKAKEKLPAPQK

SEQ ID NO: 414 - protein, 89 aa, Streptococcus agalactiae
PYSVTYAAPVICNGADLARRTAYAMSSSVTKPSDVEELVTIGDRTKRFSRLNPLGSINGRNKLPWTLFISAHRPLISHRLSLKSIKLCN

SEQ ID NO: 415 - protein, 18 aa, Streptococcus agalactiae
ANHNDKNNTISVNKFSAK

SEQ ID NO: 416 - protein, 51 aa, Streptococcus agalactiae
SFCVFCCHSKKGSYPHPKQSSWSSRFNSRSHTNDITCPYRCSKSSCKGSIT

SEQ ID NO: 417 - protein, 30 aa, Streptococcus agalactiae
TLGISFKIRGCHFSAKPFLGGKSPDFPLPG

SEQ ID NO: 418 - protein, 60 aa, Streptococcus agalactiae
FNISNSSLGFGTSAKSASTSSANSSLIISCDKATHSLQMKTPLPAIIFFTSSWLLPQNEQ

SEQ ID NO: 419 - protein, 35 aa, Streptococcus agalactiae
GVYKKQSLSLIFHQIHLIVYHFDFLHDRFVPYYRE

SEQ ID NO: 420 - protein, 87 aa, Streptococcus agalactiae
IFLRSVCGNSRQALGLTSYILHKLSSPKNGQGIALNTLSPSSSTSKNKSSKADNFIRKCLEILEISASVNRGPKVLQQLAHAVQSIS

SEQ ID NO: 421 - protein, 130 aa, Streptococcus agalactiae
SRISTITIPIRISPTFLYREDFSSGLKGSFGLRLSSVKYFFPSKVYWRRPKNIPIAASEKPRWKFTSCPRYPTTMGEIKAPRLIPKTKILKPASRRESFSPYKLPTISDTFGFNSPVPRIIRAIEMNRAV

SEQ ID NO: 422 - protein, 26 aa, Streptococcus agalactiae
SFPRSNNLCAFKDKFKCRTSSRLDCL

SEQ ID NO: 423 - protein, 41 aa, Streptococcus agalactiae
IHSFHRRKLNHHGKLNLYHLVLEKQPGLSSLLIMLYQSPDL

SEQ ID NO: 424 - protein, 155 aa, Streptococcus agalactiae
LSFSIVSHLLTTIIIPLPASCANPAIRLSYSRIPSSALITIRTTSERSMARIERITEYFSVFSYTLPDLRIPAVSIIVYSCPWLSTKLVSIASRVVPATGLAITRSSPRMALIKLDFPTFGRPIKLKRIISGFSFSSSTGRFSTIASNISPVPIP

SEQ ID NO: 425 - protein, 24 aa, Streptococcus agalactiae
CPSSDIAGINFTKNSGKIDKQTVT

SEQ ID NO: 426 - protein, 32 aa, Streptococcus agalactiae
PFLRNHFHNNETSTKFFSDSTKSRIGNTCHRC

SEQ ID NO: 427 - protein, 50 aa, Streptococcus agalactiae
ASTGSAANPQTTPGKLLQASIAPIPVPQPVITKSAAPLLSKIAVSKPFCT

SEQ ID NO: 428 - protein, 47 aa, Streptococcus agalactiae
AMPKRCFIPPEYDEIFFLPTSPKPTSSSNLGISCLAFFLSTPFKVAI

SEQ ID NO: 429 - protein, 49 aa, Streptococcus agalactiae
LLLILKNPDTTHNTTIKRQPNKPPKVLRKRTEKKSIKLMKRIPINHVAP

SEQ ID NO: 430 - protein, 44 aa, Streptococcus agalactiae
NFKARPPGVVSGLPNITPTFSLNWLIKIAIVFVLLMDADNLRIA

SEQ ID NO: 431 - protein, 47 aa, Streptococcus agalactiae
KRVGICHIYHVSQSSCFHNNKFSRYFTQFSFNIIVHSIFLSQYFSFW

SEQ ID NO: 432 - protein, 79 aa, Streptococcus agalactiae
NSTTSASLISGLISSRSGRRVNEPSSFSASNDTKAGRPKVASTASRIAGTFIDFSRTEITCPGVTRYDGISTRLPSTRI

SEQ ID NO: 433 - protein, 37 aa, Streptococcus agalactiae
TRPLVEILVDKLAPYKEANFSRNSCTLGYLAFAVTNI

SEQ ID NO: 434 - protein, 287 aa, Streptococcus agalactiae
RTRNAIRYPKASSGDYGTKREIITANKDKYSISKMCRWLNMPRSSYYYQAVESVSKTEFEETIKRIFLDSESRYGSRKIKICLNNEGITLSRRRIRRIMKRLNLVSVYQKATFKPHSRGKNEAPIPNHLDRQFKQERPLQALVTDLTYVRVGNRWAYVCLIIDLYNREIIGLSLGWHKTAELVKQAIQSIPYALTKVKMFHSDRGKEFDNQLIDEILEAFGITRSLSQAGCPYDNAVAESTYRAFKIEFVYQETFQSLEELALKTEKATLFCTTFIKCCLFRFLPML

SEQ ID NO: 435 - DNA, 2367 bp, Streptococcus agalactiae; identical to SEQ ID NO: 64

SEQ ID NO: 436 - DNA, 2802 bp, Streptococcus agalactiae; identical to SEQ ID NO: 60

SEQ ID NO: 437 - DNA, 3150 bp, Streptococcus agalactiae; identical to SEQ ID NO: 59

SEQ ID NO: 438 - DNA, 279 bp, Streptococcus agalactiae; identical to SEQ ID NO: 58

SEQ ID NO: 439 - DNA, 384 bp, Streptococcus agalactiae; identical to SEQ ID NO: 57

SEQ ID NO: 440 - DNA, 1329 bp, Streptococcus agalactiae; identical to SEQ ID NO: 56

SEQ ID NO: 441 - DNA, 2367 bp, Streptococcus agalactiae; identical to SEQ ID NO: 64

SEQ ID NO: 442 - DNA, 2802 bp, Streptococcus agalactiae; identical to SEQ ID NO: 60

SEQ ID NO: 443 - DNA, 3150 bp, Streptococcus agalactiae; identical to SEQ ID NO: 59

SEQ ID NO: 444 - DNA, 279 bp, Streptococcus agalactiae; identical to SEQ ID NO: 58

SEQ ID NO: 445 - DNA, 384 bp, Streptococcus agalactiae; identical to SEQ ID NO: 57

SEQ ID NO: 446 - DNA, 1329 bp, Streptococcus agalactiae; identical to SEQ ID NO: 56

SEQ ID NO: 447 - DNA, 1389 bp, Streptococcus agalactiae
atggctgtcgaaattattatgcctaaactcggggttgatatgcaagaaggcgaaatccttgagtggaaaaaacaggtaggtgatgttgttaatgaaggtgacgtcctacttgaaattatgtcagataaaacaaatatggagattgaagcagaagactcaggtgttttactaaaaatcacacatgggaatggagatgttgttcctgtaactgagacaattggctatatcggtgctgaaggtgaagaagtaacagaagcatcttcttctgaaaatacatcagttgaagaaaacgcgacacaagtaacttcagaaccagaaaaagttgaagaaacatcagaaccaagtgtgccagcagctacaagtggtgaaaaagtacgtgccactcctgcagctcgtaaattagcaagagagatgtctattgaccttgcactagtatctggaacaggggcaaatggtcgcgttcacagagaagatgttgaaagcttcaagggtgctcaaccacgtattacaccattggcacgtcgaattgctgaagatcaaggagttgatatagcagaaatcactggcagtggtattcgtggtaaaattgttaaaaatgatgttttggctgctatgtcaccgcaagcagcagaggctcctgtagaaacgaaagctacaccaacaacagaagaaaaacaattaccagaaggtgttgaagtcattaagatgtctgcaatgcgtaaggctatttctaaaggtatgactaactcttacctcactgctccaagctttacacttaactatgacattgatatgactgaaatgatggctcttcgcaagaaattaattgatccaatcatggctaaaacaggcttgaaagtcagctttactgatttgattggaatggccgttgttaagacattgatgaaaccagagcatcgatacctaaatgcttcattaattaacgatgcacaagaaattgagcttcataattttgttaatattggaatcgcagttggtcttgatgatggcttgattgttcctgttgttcacaatgctgatcaaatgtcactttctgactttgttatagcatctaaagatgttattaagaaaactcaagaaggtaaattaaaatcagctgaaatgtcaggttcaacattctcaattactaacttaggtatgtttggtactaagacgtttaacccaattatcaatcaaccgaactcagcaatccttggagtaggcgctactattccgactccaacagtggttgatggtgaaattgtagctcgaccaatcatggcaatgtgtttaacaattgaccaccgtattgttgatggaatgaatggtgctaagtttatggttgatcttaagaacttaatggaaaacccatttggtttacttatttga

SEQ ID NO: 448 - DNA, 1596 bp, Streptococcus agalactiae
atgtctagttttaatagaaaaaaacttaagtttttgggtatatctttggcgactctaacagccaccacagttaccctggttgcctgtggtaatgagtcaaagaactctggagataataaagttattaattggtatattcctactgaaatcagtacattggacatttcaaagaatacagatgcttattcaaacttagctataggtaattcaggcagcaatttacttagaattgataaagagggcaaaccaaaacccgatttagctaaaaaagtatccgtttcttctgatggtcttacttatactgctacacttcgtgataatttaaaatggtcagatggaagcaaactaagcgctgaagattttgtttacacatggcggagaatagttgatcctaaaactgcatctgaatatgcttacttggcgacagaatcgcaccttttaaatgctgataagattaattctggagatattaaagatttaaataaacttggtgtaacagctaaaggcaatcaagtgacctttaaattgacaagtccatgccctcaatttaaatattatttagccttctctaattttatgcctcaaaaacaatcgtatgttgaaaaagttggtaaagattatggtacaacatcaaaaaatcaaatttactcaggtccttaccttgttaaggattggaatggttcaaatggtaaatttaaattagtcaaaaataaatattattgggattctaaacatgttaaaacaaatagtgtcatagttcaaactatcaaaaaaccagatactgcagttcaaatgtacaagcaaggtcagattgattttgctgaaatatcaggaacttctgctatttataaccaaactggttcggttaaagcattgacaaatcagaaaattaggcaagctttgaatttagcgactgatcgtaaaggtgttgttaaagcggcagttgatacaggttcaactcctgctgaatctctggtccctaaaaaattagccaaattacctaatggtgaggatctttccaagtatactgccccaggttatacgtataatacaagtaaagctcaaaaactttttaaagaaggtcttgctgaggttggtcagtcatctctcaagttaacaatcacagctgattcggactctccagcagctaaaaatgctgttgactatgtgaaatctacatgggagagtgctttgcctggtctaactgttgaagaaaaatttgttactttcaagcaacgccttgaagatgcaaaaaatgaaaattttgatgtcgtgctcttctcatggggaggagattatccagaaggatcaactttctatgggttattcacgactaattctgcgtataattatggtaaattttcttctaaagagtatgacaatgcctatcaaaaggcaattactactgacgccttgaaaccaggagatgccgctaatgattacaaaactgctgaaaaagctttatttgatcaatcatattataacccagtttattacctagggaaaaaaggactccaaaattctaaattaaaggggttggtaagaaattcaactggtttgaatgttgattttacttatgcttataagacagaataa

SEQ ID NO: 449 - protein, 788 aa, Streptococcus agalactiae; identical to SEQ ID NO: 281

SEQ ID NO: 450 - protein, 933 aa, Streptococcus agalactiae; identical to SEQ ID NO: 277

SEQ ID NO: 451 - protein, 1049 aa, Streptococcus agalactiae; identical to SEQ ID NO: 276

SEQ ID NO: 452 - protein, 92 aa, Streptococcus agalactiae; identical to SEQ ID NO: 275

SEQ ID NO: 453 - protein, 127 aa, Streptococcus agalactiae; identical to SEQ ID NO: 274

SEQ ID NO: 454 - protein, 442 aa, Streptococcus agalactiae; identical to SEQ ID NO: 273

SEQ ID NO: 455 - protein, 788 aa, Streptococcus agalactiae; identical to SEQ ID NO: 281

SEQ ID NO: 456 - protein, 933 aa, Streptococcus agalactiae; identical to SEQ ID NO: 277

SEQ ID NO: 457 - protein, 1049 aa, Streptococcus agalactiae; identical to SEQ ID NO: 276

SEQ ID NO: 458 - protein, 92 aa, Streptococcus agalactiae; identical to SEQ ID NO: 275

SEQ ID NO: 459 - protein, 127 aa, Streptococcus agalactiae; identical to SEQ ID NO: 274

SEQ ID NO: 460 - protein, 442 aa, Streptococcus agalactiae; identical to SEQ ID NO: 273

SEQ ID NO: 461 - protein, 462 aa, Streptococcus agalactiae
MAVEIIMPKLGVDMQEGEILEWKKQVGDVVNEGDVLLEIMSDKTNMEIEAEDSGVLLKITHGNGDVVPVTETIGYIGAEGEEVTEASSSENTSVEENATQVTSEPEKVEETSEPSVPAATSGEKVRATPAARKLAREMSIDLALVSGTGANGRVHREDVESFKGAQPRITPLARRIAEDQGVDIAEITGSGIRGKIVKNDVLAAMSPQAAEAPVETKATPTTEEKQLPEGVEVIKMSAMRKAISKGMTNSYLTAPSFTLNYDIDMTEMMALRKKLIDPIMAKTGLKVSFTDLIGMAVVKTLMKPEHRYLNASLINDAQEIELHNFVNIGIAVGLDDGLIVPVVHNADQMSLSDFVIASKDVIKKTQEGKLKSAEMSGSTFSITNLGMFGTKTFNPIINQPNSAILGVGATIPTPTVVDGEIVARPIMAMCLTIDHRIVDGMNGAKFMVDLKNLMENPFGLLI

SEQ ID NO: 462 - protein, 531 aa, Streptococcus agalactiae
MSSFNRKKLKFLGISLATLTATTVTLVACGNESKNSGDNKVINWYIPTEISTLDISKNTDAYSNLAIGNSGSNLLRIDKEGKPKPDLAKKVSVSSDGLTYTATLRDNLKWSDGSKLSAEDFVYTWRRIVDPKTASEYAYLATESHLLNADKINSGDIKDLNKLGVTAKGNQVTFKLTSPCPQFKYYLAFSNFMPQKQSYVEKVGKDYGTTSKNQIYSGPYLVKDWNGSNGKFKLVKNKYYWDSKHVKTNSVIVQTIKKPDTAVQMYKQGQIDFAEISGTSAIYNQTGSVKALTNQKIRQALNLATDRKGVVKAAVDTGSTPAESLVPKKLAKLPNGEDLSKYTAPGYTYNTSKAQKLFKEGLAEVGQSSLKLTITADSDSPAAKNAVDYVKSTWESALPGLTVEEKFVTFKQRLEDAKNENFDVVLFSWGGDYPEGSTFYGLFTTNSAYNYGKFSSKEYDNAYQKAITTDALKPGDAANDYKTAEKALFDQSYYNPVYYLGKKGLQNSKLKGLVRNSTGLNVDFTYAYKTE

SEQ ID NO: 463 - DNA, 927 bp, Streptococcus agalactiae
atgcttaaaaaatcgcactttttacagatatttacactttgcttagccctcttaacgatttctggttgtcaattaaccgatactaaaaaacctggtcataccacaattaaggttgctgcccaaagttctacagagtctagtatcatggcaaatattgtcaccgaattaattcatcacgaattaggatacaacacaactttaataagcaatcttggttcctctacggttactcaccaagctttgctccgtggtgatgctgacattgctgccacacgttatacaggaacagacatcacaggaactcttggcttaaaagctgttaaagacactaaagaagcttctaagattgtaaaaactgaattccaaaaacgctacaatcaaacttggtatcctacttatggtttttctgatacttatgcattcatggttactaaagagtttgccagacagaataaaatcaccaagatctctgatctcaaaaagttatcaacaactatgaaggcaggggttgatagttcatggatgaatcgcgagggagatggatacactgatttcgctaaaacatacggttttgaattttcacatatttaccctatgcaaattggcttagtctatgatgcagttgaaagtaacaaaatgcaatctgtattaggctactccactgacggtcgtatttcgagctatgatttagaaattttaagggatgataaaaaattctttcctccttatgaagcctctatggttgtcaacaattctatcatcaaaaaagatcctaaactaaaaaaattactccatcgactcgatggtaaaatcaatttaaaaacgatgcaaaaccttaattatatggtagatgataaacttttagaaccttcagttgttgccaaacaatttttagaaaaaaaccattattttagaggagataaataa

SEQ ID NO: 464 - DNA, 1005 bp, Streptococcus agalactiae
ttgaaaccgtccttcaaaaaactattgctactatttagtattatcaccattttatccatcgcctgtacaccacatgcaaaagcaagtgggcgttcatggaaaagttggtttatcgaacaatacttttggctaaagcgcgataaaagttattataaagttcaagatgaaagctcatttcaaaagtacttaaatgctagccgtgaacaatctgataagggttattacttagacccaaactctgttaatggagggcttgttcaagagagactttttgatatgcaagtctattcttggaatgacaacggtaaagctaatcaaaagaccattttctatttagctggtggctcttacttaaataatccaacgccttaccatatcagcatgcttaagacgctctcaactagtcttgatgcaaaaattattttaccaatttatccaaaaactcctcgttatacctatgattatgctatccctagattggttaacctttatagacactttcatgaaaaaaacgctaatctcactttgatgggtgattcagctggcggaggattagcactaggattagcgcatgcattgtctcaccaatcagggcaagaggctattcctcaacctaaaaatattatcctcttatctccatggctagatgtgacaatgaaacatccagaaattcccaaatacgaagatactgatcctatcctatctgcttggggtctcgcacgtgtaggtgaaatttgggcaaatggttctaataatactaaccatacatatgttagtcctaaaaatgcccctgctactaaactcgctcctattacgttatttactggaacacgagaaatattcttcccagatattcgcgattatgctgcacaactccaagcagctaatcaccccgttaactatattgcacaagagggaatgaatcatgtttatccaatttaccctattgaagaagctaaaacagcacagtatcaaatgattgatatcatcaataaaactccttaa

SEQ ID NO: 465 - DNA, 3168 bp, Streptococcus agalactiae
atgacaaaaaaacatcttaaaacgcttgccttggcacttactacagtatcagtagtgacatacagccaggaggtatatggattagaaagagaggaatcggtcaaacaagaacaaacccagtcagcttcagaagatgattggttcgaagaagataatgagaggaaaacaaatgtttctaaagggaattctactgttgatgaaacagttagtgatttattttctgatggaaatagtaataactctagttctaaaaccgagtcagtggtaagtgaccctaaacaagtccccaaagcaaaaccagaggttacacaggaagcaagcaattctagtaatgatgctagcaaagtagaagtaccaaaacaggatacagcttcaaaaaaggaaaccatagaaacatcaacttgggaggcaaaagatttcgtaactagaggggatactttagtaggtttttcaaaatctggaattaataagttatctcaaacatcacacttagttttaccaagtcatgcagcagatggaactcaattgacacaagtagctagctttgcttttactccagataaaaagacggccattgcagaatatacaagtaggctaggagaaaatgggaaaccgagtcgtttagatattgatcagaaggaaattattgatgagggagaaatatttaatgcttaccagttgactaagcttactattccaaatggttataagtctattggtcaagatgcttttgtggacaataagaatattgctgaggttaaccttcctgaaagtctcgagactatttcagactatgcttttgctcacatgtctttaaaacaagtaaagttaccagataacctgaaggtcattggagaattagctttttttgataaccagattggtggtaagctttacttgccacgtcacttgataaaattagcagaacgcgctttcaaatctaatcgtattcaaacagttgaatttttgggaagtaagcttaaggttataggagaagcaagttttcaagataataatctgagtaatgttatgcttccggatggacttgaaaaaatagaatcagaagcttttacaggaaatccaggagatgaacattacaacaatcaggtcgtattgcgcacaaggacaggccaaaatccacatcaacttgcgactgagaatacttacgtcaatccggacaaatcattgtggcgtgcaacgcctgatatggattataccaaatggttagaggaagattttacctatcaaaaaaatagtgttacaggtttttcaaataaaggcttacaaaaggtaagacgtaataaaaacttagaaattccaaaacaacacaatggcattactattactgaaattggtgataacgcttttcgcaacgttgattttcaaagtaaaactttacgtaaatatgatttggaagaagtaaagctcccctcaactattcggaaaataggtgcttttgcttttcaatctaataacttgaaatcctttgaagcaagtgaagatttagaagagattaaagagggagcctttatgaataatcgtattggaactctagacttgaaagacaaacttatcaaaataggtgatgcttctttccatattaatcatattcacgccattgttcttccagaatctgtacaagaaataggacgttcagcttttcgacaaaatggtgcacttcacctgatgtttatcggaaataaggttaaaacaattggtgaaatggcttttttatccaataaactggaaagtgtaaatctctctgagcaaaaacaattaaagacaattgaggtccaagctttttcggataatgcccttagtgaagtagtcttaccgccaaatttacagactattcgtgaagaggctttcaaaaggaatcatttgaaagaagtgaagggttcatctacattatctcagattgcttttaatgcttttgatcaaaatgatggggacaaacgctttggtaagaaagtggttgttaggacacataataattctcatatgttagcagatggtgagcgttttatcattgatccagataagctatcttctacaatggtagaccttgaaaaggttttaaaaataatcgaaggtttagattactctacattacgtcagactactcaaactcagtttagagaaatgactactgcaggtaaagcgttgttatcaaaatctaacctccgacaaggagaaaaacaaaaattccttcaagaagcacaatttttccttggtcgcgttgatttggataaagccacagctaaagctgagaaggctttagtgaccaagaaggcaacaaagaatggtcatttgcttgagaggagtattaacaaagcggtattagcttataataatagcgctattaaaaaagctaatgttaagcgcttggaaaaagagttagacttgctgacagatttagtcgagggaaaaggaccattagcgcaagctacaatggtacaaggagtttatttattaaagacgcctttaccattgccagaatattatatcggattgaacgtttattttgacaagtctggaaaattgatttatgcacttgatatgagtgatactattggcgagggacaaaaagatgcatatggtaatcctatattaaatgttgacgaggataatgaaggttatcatgccttggcagttgcaactttagctgattatgaaggtctttatatcaaagatattttaaatagttcccttgataagattaaagcaatacgtcagattcctttggcaaaatatcatagattaggatttttccaagctatccgaaatgcagcggcagaagcagaccgattgattcctaagacacctaaggggtacctaaatacagtcccaaattatcgtaaaaaacaagtggagaaaaattcaaaaccagttgattataaaacgccgatttttgataaggctttacctaatgaaaaggtagatggtgatagagtggctaaaggtcataatataaatgcggagactaataattatgtagctgtaacaccaataaggtccgagcagcaattacataagtcacagtctgatgtaaatttacctcaaacaagttctaaaaataattttatatacgagattctaggatacgttagtttatgtttgcttttcctagtaactgctgggaaaaaaggaaaacgagcaagaaaataa

SEQ ID NO: 466 - DNA, 1050 bp, Streptococcus agalactiae
atgaacaaaaaaattgccgggatcggcttggcttcgattgcagtacttagtttagctgcatgtggacatcgtggtgcttctaaatctggtggtaaatcagatagcttgaaggttgcaatggtaacagataccggtggtgttgatgataaatcatttaaccaatctggttgggaaggtatgcaagcttggggcaagaagaatggccttaaaaaaggagctggttttgactatttccaatcggcaagtgaatctgattatgcaactaacttagatacagctgtgtctagtggttataaattgattttcggtattggattttctcttcatgatgctattgataaagcagcagacaataacaaagatgttaattacgtcatcgttgatgatgttattaaagggaaagataatgttgcaagtgttgtctttgcggataatgaatcagcttacttagcaggtattgcagccgctaaaactaccaaaacaaaaacagttggctttgtaggtggtatggaatctgaggttattacccgttttgaaaaaggttttgaagcaggtgtcaaatcagttgataaatcaattaaaattaaagttgactatgctggttcattcggtgatgctgctaagggtaagacaattgcagccgcacaatatgcttctggcgcagatattgtttatcaagtagctggtggaactggtgcaggtgtattcagtgaagcaaaatcacgcaatgaatctctaaaagaagctgacaaagtttgggtattaggtgtagaccgtgaccaagcagcagaaggtaagtatacttctaaagatggtaaggcttctaactttgttttggcttcatcaattaaagaagttggaaaatcagttgaattgattgctactaaaacaagtaaaggtaaattcccaggtggtaatgtaacaacttatggtttgaaggatggtggagttgatatagcaactacaaacctttcagatgacgccgttaaagcgattaaagaggctaaagctaaaattatttcaggagatatcaaagttcctagcaaataa

SEQ ID NO: 467 - DNA, 819 bp, Streptococcus agalactiae
atgaggattcaaacgacgaaccttgataaaggtggcggtggaaaaagcagtcacacctataacgaaggagattggttgtctagagttatggggaaacgagtcttgttgattgatggggccagagaatgtaatttaacacactcctttgatgtgacgagcgacaaaacaatctatgatatttttatcacaggagaatatgagatttgtcgaatcaatgataagcttagcttaattagaggagatgaacgactaactgatgaacagctagatttagccagtcgaaataataaataccttcagttattcatgtggttcagtgagcattatgaggaactggccgaacagtttgatattatcttgattgatactcataatgatgaaagtcttgttactgccaattgtattgccgtttctgatattgtcctaggggtgactgatgcgtcaactaatggatttcgtgcctggttagcccttaaaaagtttgtcgatgacatcaagaatgaagctattgaggttatcacaaagaaaagctatgtgaaggcagaagcttatctgattggcaataagattgagtattatggaaataatgtgacagagacttgtaagcaattcctggatgttgtgcaggaagatgaagcttatttgggttcaattcagaagaaagaactgatggccaaaagtttagtcattaatcagagtgtctttgaacaacgtgaacacatgacagaaaaacagaagcaagatcatcagaaattttatgataatatagaatatgtctatcaaaatattttaaccgtactagaaggagagactaaatga

SEQ ID NO: 468 - DNA, 1338 bp, Streptococcus agalactiae
gtgaaaaaagttgttttcttgaaaatacttgttccgcttgtctctttggtctttcttattagcttgggtataacgatattagcaggtgttttaggagcggttggtggttcgcagtcaaattgtacgatagaagttgtaacctcaacctctacagactcgtccatatcttcaggtgatggttccattgattcttttgttaaggagcacaaagaggcttatatcctgtcttggaaagctggtggcttcttaccatctgcatcgattacgcagaccatgattgaaaatggctttaacttcaccaatcctaatgggacctccctctggcaagcccataatatgggaggggttaaaacgtctagtaagagtaacttccccgttaccttagcaacttatggccaagatagtgttgacctttcaggaacaaagccaggagcaagagtcggcgatggcacaggtggggcttatacctggttttcaagctatgatgcagggattgtcggcaaggcagagtttatggcccatcaaactctctataccaaggcaattaacaatatagatgggatagctacactaagtgcgattgcggatggtggttgggcgactgacggaacttataaaaccaagcttattgacatgtatcataagcttggtaaaacctatgaatggctggataaggaagctatcagcgctcatggtgataaaccttataaagcaaccacagcttcagctggagatgctggactatctgatatttttacaagcaatagtaaagattgtagtgattcttcttcaggtggtgccactgatggtacaggaacagttccagcagatgcgatagcgtggggatataggcctgataacctaccagagagtctgaagcagtatatcattgatcctaaatcgcttggcatggcttatgcaaactcttctggctggtttaatccaggtagtgattatctagctggacaatgtgttaatttaacaatcagtcttggaaatcacctctggggtcactcgggatctgtcagtggcaatggaaaagaccaagctggtgcttgggccaatatctttggcaattcagtcaaaacgactcctaaaagaggagctatcttttctacccaaaacggaggtggcggttatggccatactgggattgtgtgccatgtctttgaaaatggatcaatcttgattgtggaacaaaatacgccattatcgggagctgattatttcaaaaaatcttacacatggaattaccgtatttggacacctgcccaacaaaaagcagaagtcattagttttgcttacccatatggtaaagaacctaaacttggaaactaa

SEQ ID NO: 469 - DNA, 2631 bp, Streptococcus agalactiae
atgggaaagacattttggaaagatatctatcgatcaattacgacttcaaaaggtagattttcatcaatcctcttacttatgatgttaggctcatttgcttttataggactgaaggtctcagcacctaatatgcaaagaacagcacaaaattaccttgctcatcatcatgttatggatattaccgttttcaattcttggggacttgacaaacatgatcaaactgttttagaaagcttaaaaggatcacaagttgaattttcttactttgtagatacaacccctcaacagaatagtaaatcttatcgattgtattccaataccaaaacaatatcaacctttgatcttgttaagggacgtctccctttaaataaatcagaaattgctctctcatttcaggaacgaaaaaaatatgcaataggtgataaaattaattttaaacaagataaaaacaaactgttttcaaatacaggtcctctaactattgtaggttttgttaattctaccgagatttggtctaagacaaaccttggtagttctcaaacaggggacggcgacttagatagttatggcgtattagataagacagcatttcactctccagtatatacaatggcaagggtaacttttaaagatcttaggttgattaaccctttctcaataagttacaaagaaaaagtagcgaaataccaagaaaaggtatcgcgaaaattaaatattcacaataaaataagatataccaaaacaaaaaaagagagcctacgtaaaatcgatgaggaggaaaaaagcctactaaaagctcaaaaacaaatcaatcggttagataatgatagcctagcgatgccactatctcaaagacaagctattcaaatgaaaattaaacaagaccgactatctcttttgaaacgaacaaaagagcttctaaaattgagacataacacccaaataatggaatcgcctcaaattattgtctacaaccgtactacctttcctggaggacaaggatataacacttttgactccagtacaaatagcacttctaaaatcagtaatcttttccccattattttatatttagtcgcagcattagtaaccttaacaacaatgactaggttcgtcgaggaagaaagaaccaacgcaggcatattaaaagcactaggctatagtgaccgccaagttatctttaaatttattatttatggttttatagcaggaacattagggactactttgggtatcattggagggcattatcttttacctcgtattatttctgatatcatttccaaagacctgactattccaaacacacagtatcatcttttcttaaattacagtttactagcctttgttttttcattattaagcattgttcttccagtttttgttatcactcgacgtgagttgaaagaaaaagcagcatttttattattaccaaaaccaccagctaaaggatctaaaatagctttagagtatatcaattggatttggaaaaaactgtccttcacacaaaaagtaactgctagaaatatttttcgttacaaacaaaggatgattatgaccatatttggagttgctggatcagtagcgctcttattttcaggtctaggaatacaatcctccttaaagcaaaccgtcaatgaacatttcggtcgtattatgccctatgatatattgctaacatataacacaaatgcttctcccccaaaaatacttgaactactttcaaaagattcaaaaatagacaaataccaaccaatacaccttgaaaatcttgacgaatccattcctggacaaattaataaacagtcaatttccctattcataacagacaaaaaacaattactaccttttatttatttacaagaagcaacaactaataagtcattgcacttgaataataaagggattattatttctaaaaaattagctcaattttatcatgttaataccggtgattttatccatttatctcattcacaaacacttccttctagaaaattaaaaataacaggagttgtcaatgcgaatgttggtcactatatttttatgacaaaacaatactatcgaactatttttaagaaagaaactaaagataacgcttttttggttaagttaaccaaacataaaatcgcaaataacttagcagaaaaacttttagaaattaatggagttgagtctcttacgcaaaatgctcttcagctagctagtgtagaagccgttgtgcgttctttagatggctctatgactattttagttgtcgtatctttattgttagccattgtaattctctataatctcactaatattaatttagcagaacgtaagcgggagctatcaactataaaggtattaggtttttataatgaagaagtaactttatacatttaccgcgaaaccattattttatcaaccatcggtgtgattctaggcaccattagcggtacttatttacaccgtcaaatgatgttgctaattggttcagatcaaatactttttggtgaaaaagtatcaccaactacatttataataccaataagcgtagtagtcatcattctaataagtctatgttttatagttaaccatcaattaaaaaaactcaatatgttagatgccttgaaatcagtagattag

SEQ ID NO: 470 - DNA, 711 bp, Streptococcus agalactiae
atgaataaaagaaaattattaacagtcttatcaattgcatcagttgcagttttatcaagtgttacttttgcagatgaaataactccatctgatccaacagcaccatcaacaccccttattactccaaccccagtagatcctggaacaccaactgatacgacaaaacctagtactccagtagatcctggaacgccaactgatacgacaaaacctagtactccagtagatcctggaacaccaactgatacgacaaaacctagtactccagtagattcagggacttcgactaatccctcagattcagaagcaacaaatacaaatctaggtacaaaaccaacagatgtagttaagccagagacacctaaaatccctgaagtgccgtcaacagtaactccagatgtgattgacaaggtagacaaagaaacaggtaatattacgattaaaccaattcaaatcagccctgataaaacgattattggaacacaaaatggtaatgtcattattcgagatagttcaggcagccacttagtatctgcaagtgaagttggtggtcgacttaatgaagatgggacagtaacaattaaagattcgtcagggaaaacaaaaacactccctcgtactggagaagctaaaggattcttaagcattattggtgccacaatcctatcttttgtagcttatttattcaagcagagagtaactttaaattaa

SEQ ID NO: 471 - DNA, 2565 bp, Streptococcus agalactiae
atgagacctatcgttagaaaaaagatgtacaaaaaaggtaaatttttggtcattgcaggtatcgttactattttaggtggtagtgcaattcttggtcaagatgtcaaggcagaacaggcagaagcagcaacttcaacgatctcagagaaaactgatagcagtcagactatttcggatacttccaagttaacgttacctgttaattcctcggaggctatgaaaaatagtgcagagcctttaataaaaacaggctttgctacatctgtttcatctaatcctagagagatagcagctaccccagtcaaaacctttgatgctagttcaaaagttgttgtaaaagctagtactgctgagcactcagcaaatcaaacaaattctaatgttaatcaagtagctaatgatagtgaagttattactcaacaaaattcaacaaagcaattaccaaaagtgacttactctgctcatgttcaagatattggatggcaaaagtcggttgataatgcaacagtttcaggaacagtaggacaggaaaagcaggttgaggcaataaaattgtctattaaagcccctgaaggaataacaggaaaacttagctataaaacttatgttaaaggacaaggttggcaaccttcagtagagagtggtcaagttagtggtactgttggtcagagtagacctattgaagcactaagcattaaccttactgataatttacaaaaattatatgatgtctattatcgtgttcatgttcaagatatcgggtggatggcttgggctaaaaatggagcttacgctgggactttgggaatgtcaaagcgccttgaagcttacgaagtaaagtttacccttaaaggacaatctgttttaacaccaactatacttaaggaagagagacctgtcttaaattatcaggttaaggtaggccaaaatggttggcaatctaataaacttgaaggacaaatggcgggaactttaggagaatccaaagccctagatggagtaaaattcactcttagcaccttgaagtatggggacattctctatcgtactcatgtacaagataaaggttggggagaaattttaggtagtcaaacaagtaaggattatcaaggaaaaagactagaagctattcaattggacttaagtgggaatttaaaacaaaattatgatatttattatcgcgctcacgtccaagataaaggttggatggcttggcaaaaaaataatagtgtagcaggtacagtcggagaatcgaaacgtttagaggctttggaagtaaaactagtagctaaagcttcagattttagttcccaaacaaatcattcattcttagaaatgaagcatcctggattaagttatcaaacttatcttcaaaaagatggttggaaaccaacggttttggaaggccaattaggaggtagtattggactttcaaaatctataaaagccatcaaacttaacttaggtagtacagctctaggaaatatagaatatagaacttttcttaatggttcaggttggcaaactgttgttaattcagggagagaaagtaatgtaccaaatgaatctcaacaagtagaagctattcagatgcgattgacaggtctgctatcgaaaacctatagtgtgatgtatcgagttcacatgcaagattatggttggcaggattggacttataacaatgacatcgctggtagtactaaccaaggaaaacgaattgaagcaatcgaaattaaattagttgagactgctaaaatacctataactgtccaaacgacctataagggaactggaaactataatgtacgagtgacaaatgttattagtcctgggaatttaaaaattgctatttggtcagataaaaacaatcaggatgaccttaagtggtataccgtcacacccaaaaatcatgaagctagattgacatttaatgttacaaatcatagagacaatggtaaatactttatccatgtttatcaggaaaatgcttctaatcaaaaacaattattggtaaaaacttctctacaagtcgcacattcaaattataatactccttactttagccaacgtgatggaaggtgggcaagtcgaagatatggtatggcaactttaggagaaactggttgtgtaccaacttctctagctatgattttgtcttctttgaaaggagaaactgttttaccaacgcaaattgcagattacctttaccataagacagttgaatttaatcgtggtgttcaaggaacaacttctagaggaatcttaaaagcagccaaagaatggggtgtaacagcaactgcattaggaactcaagctaaccttgtacaagcgttgaaggatggttatcatgtcctagcggcagtacaaaataatgtttttgttcttcatggaagtcatgaaatcgttctcaaaggatataataacggactgacacatgtctctgacccttacacaccgtccttgtctggttggtatccaatttcacaactttggaaagaacagagctattatagtgaggatagaattgatattggagaaccttttgtcaaggtaacagatgcctaa

SEQ ID NO: 472 - DNA, 1179 bp, Streptococcus agalactiae
atggcaagaatcccttatcagaaaacacttattttttgtgtagccgttattattgctatttttattttgggattatctaaggatttagcacaatctaaagggcaaaaggttgcaaataataatactgtaaaaacagcacgtgtggttgcaaacggagatattttgctgcacgatgtactatatgccagtgcgcgccaacccgacggcacttataattttactccttattttaaagaggtaaaatcttggattgagagcgctgatttagcgattggtgattatgaagggacgattagttcagaatatcctttagcaggctatcctttatttaatgctcctaatgagattgcaactactatgaaagaaactggatatgatgtcgttgacttagcacataatcatattctggattcacaactggcaggtgctatcaatactgtcaagacttttaatcgtatgggattggatactattggggtttatttaaaggatagaaataaagaagatatcttaattaagcgtgtaaatggtataaaaattgctattttaggttattcgtatggctacaatggtatggaagctaatgtttcaaagagtgactatgaaaaacatatgtctgatttagatactaaaaagattaagcaagatattaaaaaggctgaaaaagaagcagatatcaccattgtcatgccacagatggggatagaatatcaaaaaaaacctactacagaacaagtaatgctttatcacagtatgattaaatggggggcagatattatattcggaggacaccctcacgttgttgaaccgtctgaagtgataaaaaaagatggccagaaaaaatttattatttactctatgggaaattttatttcaaatcagcgtttagaaacagttgatgatatctggacagaaagaggattattaatggatgtaacaatagagaaaaaaggtcaaaaaacagtaattaaaaaagttaaggcgcatccaacactagtagaagcaaaagcaaatggccgttatgttgaagaaggctttccagcttatgattataggacgctagttttagaggattatattgaaggtggtaagaaacgttctacgattgatcagactatgaaagataaagttgataaagcatataaggagatgaatgagttagttaatttgaagtggtaa

SEQ ID NO: 473 - DNA, 1380 bp, Streptococcus agalactiae
atgaaacatttctttgattacaagacaatgtctgtcgcacgtaaactcagcattagttttatcgctgttatcctattgggaagtattttactttcacttccaatttttcaatatgctaacgcccctaaaacacattacattgatcaccttttcacgactgtttcaatggtatgtgtaactggtttatctgtttttcctatcagtaaggtttataacggttgggggcagattgtagctattttactcatgcaaacagggggacttggtttagtaacactaatgtcgttgtcttactataccctaagacgtaaaatgtcgttaaatgatcagacccttttgcagtcagcgataacttataacagttcgacagatttaaaaaaatatctctatatgatttttaaagtaactttaactttagaagttttagcagccagcattttagccatagattttattcctcgatttggtttgggtcatggtatctttaatagtatattcttagctgtctcagccttttgtaatgccggttttgataatctaggggcaacgagcttagctcaatttaaactaaatcctttggttaacattatcgtttgtttcttgattatttcaggaggacttggatttgccgtatggaaagatttaattgaagctactatacaaacatctcacaagggaccaaaattaatcaagacatttccaaaacgcctcagcaaccattctaaactggttttaaaaacaacaaccattattttactaacaggaactttgctttcttggttgttagagtttggaaattttagaacaattgctaatttatctctacctaaacaactaatggtcagctttttccaaacagttacgatgcgtaccgctggattttcaactattgattatacccaaactgatttcgcaaccaaccttgtttatattatccaaatgttaattggaggagctcctggtggaacggcaggaggatttaaagtcactgttatcgccattttactcttactatttaaggccgaactgagtggccaaagccaagtgacttttcattatcgaacaattccttccagtattattaaacaaacactatcgattttaactttcttttttatcatacttattagcggctatctccttcttctggaactcaatccccatatagatcctttttctcttttctttgaggcatctagtgccttagcaaccgtgggtgtgacaatgaacactaccaatcaattaagtctgggcggtcgaattgtaattatgttcctcatgtttattggtcgagtcggtccaattaccgtactgctatcaattcttcagaaaaaagagaaggaaattcactatgctgaaacagaaattattctaggttag

SEQ ID NO: 474 - DNA, 2319 bp, Streptococcus agalactiae
atgttagacgaattaaaagcaatcataaaaagcccaaaattatggattacgatggctggggttgcactgattccaacgctatataatgttatctttctaagctcaatgtgggatccttatgggaatactaaaaatttacctgtggcagtcgttaaccaagataaatcggctaaattaaatggaaaaactatttcaattggcaaagatatggaggacaatttgtctaaaaatgatagcttagatttccattttacaacagctaaaagagcagaaaaagaattagaaaagggtcactattatatggttattacctttcctaaagatctttctagaaaagcgacaactctcatgacagaaaaaccagaaaggttaaatattacttataaaactactaaggggcgtagttttgtagcttcaaaaatgagtgagacagcagctaataaactaaaagatgaggtagcagaatctattacagggacttatactgaatcagtttttaaaaatatgggttctatgaaaacaggtatcaataaagctgctgatgggagtcaagaattattaaatggttctaataagctacaggatgggagccaaaccttgacaagtaatttagatgttttagcaagctctagtcaaactttttctggaggagctaataaactaaatagtggaataaacctttatacagatggtgtggggaccctatctaacgggttagaaacattatcagatggtgttactgcttacacaacaggtgtgcataagttgagtgaaggtagtcaaaaattagatgataagtctcaagcattggtggaaggatcagaaaagttgacggatggtttacaacaattgtcacaagcaactcaactaaaaccagagcaagaacgtactttgcagaacctttcagatggattaaagaatctaaatcagattattacaaatttacaatcgacagcaactactgatagcgatactaatagtaagttatttaattttttatcaactattgaatcaagtacaaaggctttgatgaatacggctgctgctgataaacaaaagcaaatgactgcggtacaatcaacgtcagcttttaaaagtttaacccctgaacaacaatctcaaatcacctcagcggttactggaacacctacttcagctgagacaattgcagcaaatatttcttcaaatatagaaaatatgaaaactgtgcttagtgaagcatctagttcagccccttctaataatggatcacaaaatcttcaaactttgtcaggaacagctaacaatttagtattaaaagctatctcagatttagataaaattcaaaaattgccaacggctactaagcagttatatcaaggtagtcaaaccttgacaaaaggaatcacggattatacgaatgctgtagggcaattacgcaaaggtgcagtaactttagatagtaaatccaatcaattgatttcaggaacacaaaaagcaagtcagggagctcaaactttagatagtaaatcggatcaattgagagacggagcggggcaattagctagtggttctgatagaattgcagatggttctaataagcttgctgggggaggacatcagttgatagatgggttgacagagttgtcaggtggtgtttctcaattatcaagttctttggggaaagctggggaccagttgtccatggtttctgtaaataaagataatgccaatgcagtatctagcccagtcactatcaagcatgaagattatgatagcgttgatacgaatggtgttggaatggcaccatacatgatttcagttgcgttgatggtggtagctttatcagccaatgttatttttgcgaaagctttatctggcaaagagccagctaatcgttttagttgggctaaaaataaattattaatcaatggattcattgcaactctagcagcaactatcttattttttgcagttcaattcataggtcttaaaccagattaccctggaaaaacctactttattatcctattgacagcatggactttgatggcattagtaactgctttagtgggatgggataataggtatggttccttcttgtcgttattaatattattattccagcttggttcaagcgcaggaacttacccaatagaattgagtcctaagttctttcaaacaattcaaccatttttaccgatgacttactctgtttcaggattaagagagaccatctcgttgacgggagacgttaaccatcaatggagaatgctagtaatctttttagtatcatcgatgatacttgctcttcttatttatcgtaaacaagaagattaa

SEQ ID NO: 475 - protein, 308 aa, Streptococcus agalactiae
MLKKSHFLQIFTLCLALLTISGCQLTDTKKPGHTTIKVAAQSSTESSIMANIVTELIHHELGYNTTLISNLGSSTVTHQALLRGDADIAATRYTGTDITGTLGLKAVKDTKEASKIVKTEFQKRYNQTWYPTYGFSDTYAFMVTKEFARQNKITKISDLKKLSTTMKAGVDSSWMNREGDGYTDFAKTYGFEFSHIYPMQIGLVYDAVESNKMQSVLGYSTDGRISSYDLEILRDDKKFFPPYEASMVVNNSIIKKDPKLKKLLHRLDGKINLKTMQNLNYMVDDKLLEPSVVAKQFLEKNHYFRGDK

SEQ ID NO: 476 - protein, 334 aa, Streptococcus agalactiae
LKPSFKKLLLLFSIITILSIACTPHAKASGRSWKSWFIEQYFWLKRDKSYYKVQDESSFQKYLNASREQSDKGYYLDPNSVNGGLVQERLFDMQVYSWNDNGKANQKTIFYLAGGSYLNNPTPYHISMLKTLSTSLDAKIILPIYPKTPRYTYDYAIPRLVNLYRHFHEKNANLTLMGDSAGGGLALGLAHALSHQSGQEAIPQPKNIILLSPWLDVTMKHPEIPKYEDTDPILSAWGLARVGEIWANGSNNTNHTYVSPKNAPATKLAPITLFTGTREIFFPDIRDYAAQLQAANHPVNYIAQEGMNHVYPIYPIEEAKTAQYQMIDIINKTP

SEQ ID NO: 477 - protein, 1055 aa, Streptococcus agalactiae
MTKKHLKTLALALTTVSVVTYSQEVYGLEREESVKQEQTQSASEDDWFEEDNERKTNVSKGNSTVDETVSDLFSDGNSNNSSSKTESVVSDPKQVPKAKPEVTQEASNSSNDASKVEVPKQDTASKKETIETSTWEAKDFVTRGDTLVGFSKSGINKLSQTSHLVLPSHAADGTQLTQVASFAFTPDKKTAIAEYTSRLGENGKPSRLDIDQKEIIDEGEIFNAYQLTKLTIPNGYKSIGQDAFVDNKNIAEVNLPESLETISDYAFAHMSLKQVKLPDNLKVIGELAFFDNQIGGKLYLPRHLIKLAERAFKSNRIQTVEFLGSKLKVIGEASFQDNNLSNVMLPDGLEKIESEAFTGNPGDEHYNNQVVLRTRTGQNPHQLATENTYVNPDKSLWRATPDMDYTKWLEEDFTYQKNSVTGFSNKGLQKVRRNKNLEIPKQHNGITITEIGDNAFRNVDFQSKTLRKYDLEEVKLPSTIRKIGAFAFQSNNLKSFEASEDLEEIKEGAFMNNRIGTLDLKDKLIKIGDASFHINHIHAIVLPESVQEIGRSAFRQNGALHLMFIGNKVKTIGEMAFLSNKLESVNLSEQKQLKTIEVQAFSDNALSEVVLPPNLQTIREEAFKRNHLKEVKGSSTLSQIAFNAFDQNDGDKRFGKKVVVRTHNNSHMLADGERFIIDPDKLSSTMVDLEKVLKIIEGLDYSTLRQTTQTQFREMTTAGKALLSKSNLRQGEKQKFLQEAQFFLGRVDLDKATAKAEKALVTKKATKNGHLLERSINKAVLAYNNSAIKKANVKRLEKELDLLTDLVEGKGPLAQATMVQGVYLLKTPLPLPEYYIGLNVYFDKSGKLIYALDMSDTIGEGQKDAYGNPILNVDEDNEGYHALAVATLADYEGLYIKDILNSSLDKIKAIRQIPLAKYHRLGFFQAIRNAAAEADRLIPKTPKGYLNTVPNYRKKQVEKNSKPVDYKTPIFDKALPNEKVDGDRVAKGHNINAETNNYVAVTPIRSEQQLHKSQSDVNLPQTSSKNNFIYEILGYVSLCLLFLVTAGKKGKRARK

SEQ ID NO: 478 - protein, 349 aa, Streptococcus agalactiae
MNKKIAGIGLASIAVLSLAACGHRGASKSGGKSDSLKVAMVTDTGGVDDKSFNQSGWEGMQAWGKKNGLKKGAGFDYFQSASESDYATNLDTAVSSGYKLIFGIGFSLHDAIDKAADNNKDVNYVIVDDVIKGKDNVASVVFADNESAYLAGIAAAKTTKTKTVGFVGGMESEVITRFEKGFEAGVKSVDKSIKIKVDYAGSFGDAAKGKTIAAAQYASGADIVYQVAGGTGAGVFSEAKSRNESLKEADKVWVLGVDRDQAAEGKYTSKDGKASNFVLASSIKEVGKSVELIATKTSKGKFPGGNVTTYGLKDGGVDIATTNLSDDAVKAIKEAKAKIISGDIKVPSK

SEQ ID NO: 479 - protein, 272 aa, Streptococcus agalactiae
MRIQTTNLDKGGGGKSSHTYNEGDWLSRVMGKRVLLIDGARECNLTHSFDVTSDKTIYDIFITGEYEICRINDKLSLIRGDERLTDEQLDLASRNNKYLQLFMWFSEHYEELAEQFDIILIDTHNDESLVTANCIAVSDIVLGVTDASTNGFRAWLALKKFVDDIKNEAIEVITKKSYVKAEAYLIGNKIEYYGNNVTETCKQFLDVVQEDEAYLGSIQKKELMAKSLVINQSVFEQREHMTEKQKQDHQKFYDNIEYVYQNILTVLEGETK

SEQ ID NO: 480 - protein, 445 aa, Streptococcus agalactiae
VKKVVFLKILVPLVSLVFLISLGITILAGVLGAVGGSQSNCTIEVVTSTSTDSSISSGDGSIDSFVKEHKEAYILSWKAGGFLPSASITQTMIENGFNFTNPNGTSLWQAHNMGGVKTSSKSNFPVTLATYGQDSVDLSGTKPGARVGDGTGGAYTWFSSYDAGIVGKAEFMAHQTLYTKAINNIDGIATLSAIADGGWATDGTYKTKLIDMYHKLGKTYEWLDKEAISAHGDKPYKATTASAGDAGLSDIFTSNSKDCSDSSSGGATDGTGTVPADAIAWGYRPDNLPESLKQYIIDPKSLGMAYANSSGWFNPGSDYLAGQCVNLTISLGNHLWGHSGSVSGNGKDQAGAWANIFGNSVKTTPKRGAIFSTQNGGGGYGHTGIVCHVFENGSILIVEQNTPLSGADYFKKSYTWNYRIWTPAQQKAEVISFAYPYGKEPKLGN

SEQ ID NO: 481 - protein, 876 aa, Streptococcus agalactiae
MGKTFWKDIYRSITTSKGRFSSILLLMMLGSFAFIGLKVSAPNMQRTAQNYLAHHHVMDITVFNSWGLDKHDQTVLESLKGSQVEFSYFVDTTPQQNSKSYRLYSNTKTISTFDLVKGRLPLNKSEIALSFQERKKYAIGDKINFKQDKNKLFSNTGPLTIVGFVNSTEIWSKTNLGSSQTGDGDLDSYGVLDKTAFHSPVYTMARVTFKDLRLINPFSISYKEKVAKYQEKVSRKLNIHNKIRYTKTKKESLRKIDEEEKSLLKAQKQINRLDNDSLAMPLSQRQAIQMKIKQDRLSLLKRTKELLKLRHNTQIMESPQIIVYNRTTFPGGQGYNTFDSSTNSTSKISNLFPIILYLVAALVTLTTMTRFVEEERTNAGILKALGYSDRQVIFKFIIYGFIAGTLGTTLGIIGGHYLLPRIISDIISKDLTIPNTQYHLFLNYSLLAFVFSLLSIVLPVFVITRRELKEKAAFLLLPKPPAKGSKIALEYINWIWKKLSFTQKVTARNIFRYKQRMIMTIFGVAGSVALLFSGLGIQSSLKQTVNEHFGRIMPYDILLTYNTNASPPKILELLSKDSKIDKYQPIHLENLDESIPGQINKQSISLFITDKKQLLPFIYLQEATTNKSLHLNNKGIIISKKLAQFYHVNTGDFIHLSHSQTLPSRKLKITGVVNANVGHYIFMTKQYYRTIFKKETKDNAFLVKLTKHKIANNLAEKLLEINGVESLTQNALQLASVEAVVRSLDGSMTILVVVSLLLAIVILYNLTNINLAERKRELSTIKVLGFYNEEVTLYIYRETIILSTIGVILGTISGTYLHRQMMLLIGSDQILFGEKVSPTTFIIPISVVVIILISLCFIVNHQLKKLNMLDALKSVD

SEQ ID NO: 482 - protein, 236 aa, Streptococcus agalactiae
MNKRKLLTVLSIASVAVLSSVTFADEITPSDPTAPSTPLITPTPVDPGTPTDTTKPSTPVDPGTPTDTTKPSTPVDPGTPTDTTKPSTPVDSGTSTNPSDSEATNTNLGTKPTDVVKPETPKIPEVPSTVTPDVIDKVDKETGNITIKPIQISPDKTIIGTQNGNVIIRDSSGSHLVSASEVGGRLNEDGTVTIKDSSGKTKTLPRTGEAKGFLSIIGATILSFVAYLFKQRVTLN

SEQ ID NO: 483 - protein, 854 aa, Streptococcus agalactiae
MRPIVRKKMYKKGKFLVIAGIVTILGGSAILGQDVKAEQAEAATSTISEKTDSSQTISDTSKLTLPVNSSEAMKNSAEPLIKTGFATSVSSNPREIAATPVKTFDASSKVVVKASTAEHSANQTNSNVNQVANDSEVITQQNSTKQLPKVTYSAHVQDIGWQKSVDNATVSGTVGQEKQVEAIKLSIKAPEGITGKLSYKTYVKGQGWQPSVESGQVSGTVGQSRPIEALSINLTDNLQKLYDVYYRVHVQDIGWMAWAKNGAYAGTLGMSKRLEAYEVKFTLKGQSVLTPTILKEERPVLNYQVKVGQNGWQSNKLEGQMAGTLGESKALDGVKFTLSTLKYGDILYRTHVQDKGWGEILGSQTSKDYQGKRLEAIQLDLSGNLKQNYDIYYRAHVQDKGWMAWQKNNSVAGTVGESKRLEALEVKLVAKASDFSSQTNHSFLEMKHPGLSYQTYLQKDGWKPTVLEGQLGGSIGLSKSIKAIKLNLGSTALGNIEYRTFLNGSGWQTVVNSGRESNVPNESQQVEAIQMRLTGLLSKTYSVMYRVHMQDYGWQDWTYNNDIAGSTNQGKRIEAIEIKLVETAKIPITVQTTYKGTGNYNVRVTNVISPGNLKIAIWSDKNNQDDLKWYTVTPKNHEARLTFNVTNHRDNGKYFIHVYQENASNQKQLLVKTSLQVAHSNYNTPYFSQRDGRWASRRYGMATLGETGCVPTSLAMILSSLKGETVLPTQIADYLYHKTVEFNRGVQGTTSRGILKAAKEWGVTATALGTQANLVQALKDGYHVLAAVQNNVFVLHGSHEIVLKGYNNGLTHVSDPYTPSLSGWYPISQLWKEQSYYSEDRIDIGEPFVKVTDA

SEQ ID NO: 484 - protein, 392 aa, Streptococcus agalactiae
MARIPYQKTLIFCVAVIIAIFILGLSKDLAQSKGQKVANNNTVKTARVVANGDILLHDVLYASARQPDGTYNFTPYFKEVKSWIESADLAIGDYEGTISSEYPLAGYPLFNAPNEIATTMKETGYDVVDLAHNHILDSQLAGAINTVKTFNRMGLDTIGVYLKDRNKEDILIKRVNGIKIAILGYSYGYNGMEANVSKSDYEKHMSDLDTKKIKQDIKKAEKEADITIVMPQMGIEYQKKPTTEQVMLYHSMIKWGADIIFGGHPHVVEPSEVIKKDGQKKFIIYSMGNFISNQRLETVDDIWTERGLLMDVTIEKKGQKTVIKKVKAHPTLVEAKANGRYVEEGFPAYDYRTLVLEDYIEGGKKRSTIDQTMKDKVDKAYKEMNELVNLKW

SEQ ID NO: 485 - protein, 459 aa, Streptococcus agalactiae
MKHFFDYKTMSVARKLSISFIAVILLGSILLSLPIFQYANAPKTHYIDHLFTTVSMVCVTGLSVFPISKVYNGWGQIVAILLMQTGGLGLVTLMSLSYYTLRRKMSLNDQTLLQSAITYNSSTDLKKYLYMIFKVTLTLEVLAASILAIDFIPRFGLGHGIFNSIFLAVSAFCNAGFDNLGATSLAQFKLNPLVNIIVCFLIISGGLGFAVWKDLIEATIQTSHKGPKLIKTFPKRLSNHSKLVLKTTTIILLTGTLLSWLLEFGNFRTIANLSLPKQLMVSFFQTVTMRTAGFSTIDYTQTDFATNLVYIIQMLIGGAPGGTAGGFKVTVIAILLLLFKAELSGQSQVTFHYRTIPSSIIKQTLSILTFFFIILISGYLLLLELNPHIDPFSLFFEASSALATVGVTMNTTNQLSLGGRIVIMFLMFIGRVGPITVLLSILQKKEKEIHYAETEIILG

SEQ ID NO: 486 - protein, 772 aa, Streptococcus agalactiae
MLDELKAIIKSPKLWITMAGVALIPTLYNVIFLSSMWDPYGNTKNLPVAVVNQDKSAKLNGKTISIGKDMEDNLSKNDSLDFHFTTAKRAEKELEKGHYYMVITFPKDLSRKATTLMTEKPERLNITYKTTKGRSFVASKMSETAANKLKDEVAESITGTYTESVFKNMGSMKTGINKAADGSQELLNGSNKLQDGSQTLTSNLDVLASSSQTFSGGANKLNSGINLYTDGVGTLSNGLETLSDGVTAYTTGVHKLSEGSQKLDDKSQALVEGSEKLTDGLQQLSQATQLKPEQERTLQNLSDGLKNLNQIITNLQSTATTDSDTNSKLFNFLSTIESSTKALMNTAAADKQKQMTAVQSTSAFKSLTPEQQSQITSAVTGTPTSAETIAANISSNIENMKTVLSEASSSAPSNNGSQNLQTLSGTANNLVLKAISDLDKIQKLPTATKQLYQGSQTLTKGITDYTNAVGQLRKGAVTLDSKSNQLISGTQKASQGAQTLDSKSDQLRDGAGQLASGSDRIADGSNKLAGGGHQLIDGLTELSGGVSQLSSSLGKAGDQLSMVSVNKDNANAVSSPVTIKHEDYDSVDTNGVGMAPYMISVALMVVALSANVIFAKALSGKEPANRFSWAKNKLLINGFIATLAATILFFAVQFIGLKPDYPGKTYFIILLTAWTLMALVTALVGWDNRYGSFLSLLILLFQLGSSAGTYPIELSPKFFQTIQPFLPMTYSVSGLRETISLTGDVNHQWRMLVIFLVSSMILALLIYRKQED

SEQ ID NO: 487 - protein, 11 aa, Artificial Sequence
  Description of Artificial Sequence:  Synthetic Peptide
KLKLLLLLKLK

SEQ ID NO: 488 - protein, 36 aa, Artificial Sequence
  Description of Artificial Sequence:  Synthetic Peptide
RLAGLLRKGGEKIGEKLKKIGQKIKNFFQKLVPQPE

SEQ ID NO: 489 - protein, 17 aa, Artificial Sequence
  Description of Artificial Sequence:  Synthetic Peptide
MEYKGNFSQKTINRFKS

SEQ ID NO: 490 - protein, 16 aa, Artificial Sequence
  Description of Artificial Sequence:  Synthetic Peptide
QTQRSGKINTDFMRQL

SEQ ID NO: 491 - protein, 19 aa, Artificial Sequence
  Description of Artificial Sequence:  Synthetic Peptide
VKTIGYGKLTGKVNHHYVA

SEQ ID NO: 492 - protein, 23 aa, Artificial Sequence
  Description of Artificial Sequence:  Synthetic Peptide
VKTIGYGKLTGKVNHHYVANKDG

SEQ ID NO: 493 - protein, 17 aa, Artificial Sequence
  Description of Artificial Sequence:  Synthetic Peptide
VNHHYVANKDGSVTAFV

SEQ ID NO: 494 - protein, 22 aa, Artificial Sequence
  Description of Artificial Sequence:  Synthetic Peptide
AAVNQNIVFRVLTKDGRPIFEK

SEQ ID NO: 495 - protein, 9 aa, Artificial Sequence
  Description of Artificial Sequence:  Synthetic Peptide
TVIKKGTNL

SEQ ID NO: 496 - protein, 25 aa, Artificial Sequence
  Description of Artificial Sequence:  Synthetic Peptide
VTHTTEKSKPVEPQKATPKAPAKGL

SEQ ID NO: 497 - protein, 14 aa, Artificial Sequence
  Description of Artificial Sequence:  Synthetic Peptide
RQELLTPTQLSKLQ

SEQ ID NO: 498 - protein, 19 aa, Artificial Sequence
  Description of Artificial Sequence:  Synthetic Peptide
VRYDKLEALVAYHGAKSAS

SEQ ID NO: 499 - protein, 16 aa, Artificial Sequence
  Description of Artificial Sequence:  Synthetic Peptide
HQPNRIYLTDKLVPYI

SEQ ID NO: 500 - protein, 15 aa, Artificial Sequence
  Description of Artificial Sequence:  Synthetic Peptide
QSIKQHDKEKLRTVL

SEQ ID NO: 501 - protein, 17 aa, Artificial Sequence
  Description of Artificial Sequence:  Synthetic Peptide
MEYKGNFSQKTINRFKS

SEQ ID NO: 502 - protein, 16 aa, Artificial Sequence
  Description of Artificial Sequence:  Synthetic Peptide
QTQRSGKINTDFMRQL

SEQ ID NO: 503 - protein, 19 aa, Artificial Sequence
  Description of Artificial Sequence:  Synthetic Peptide
VKTIGYGKLTGKVNHHYVA

SEQ ID NO: 504 - protein, 23 aa, Artificial Sequence
  Description of Artificial Sequence:  Synthetic Peptide
VKTIGYGKLTGKVNHHYVANKDG

SEQ ID NO: 505 - protein, 17 aa, Artificial Sequence
  Description of Artificial Sequence:  Synthetic Peptide
VNHHYVANKDGSVTAFV

SEQ ID NO: 506 - protein, 22 aa, Artificial Sequence
  Description of Artificial Sequence:  Synthetic Peptide
AAVNQNIVFRVLTKDGRPIFEK

SEQ ID NO: 507 - protein, 9 aa, Artificial Sequence
  Description of Artificial Sequence:  Synthetic Peptide
TVIKKGTNL

SEQ ID NO: 508 - protein, 25 aa, Artificial Sequence
  Description of Artificial Sequence:  Synthetic Peptide
VTHTTEKSKPVEPQKATPKAPAKGL

SEQ ID NO: 509 - protein, 14 aa, Artificial Sequence
  Description of Artificial Sequence:  Synthetic Peptide
RQELLTPTQLSKLQ

SEQ ID NO: 510 - protein, 19 aa, Artificial Sequence
  Description of Artificial Sequence:  Synthetic Peptide
VRYDKLEALVAYHGAKSAS

SEQ ID NO: 511 - protein, 16 aa, Artificial Sequence
  Description of Artificial Sequence:  Synthetic Peptide
HQPNRIYLTDKLVPYI

SEQ ID NO: 512 - protein, 15 aa, Artificial Sequence
  Description of Artificial Sequence:  Synthetic Peptide
QSIKQHDKEKLRTVL

SEQ ID NO: 513 - protein, 13 aa, Artificial Sequence
  Description of Artificial Sequence:  Synthetic Peptide
EGDVLLEIMSDKT

SEQ ID NO: 514 - protein, 12 aa, Artificial Sequence
  Description of Artificial Sequence:  Synthetic Peptide
PGLTVEEKFVTF

The invention claimed is:

1. A composition comprising an isolated hyperimmune serum-reactive antigen fragment consisting of an amino acid sequence of 399-417, 503-519, 544-563, 489-556, 386-458, or 458-624 of SEQ ID NO:364.

2. The composition of claim 1, wherein the hyperimmune serum-reactive antigen fragment binds to anti-*S. agalactiae* serum.

3. The composition of claim 1, further defined as comprising at least two different hyperimmune serum-reactive antigen fragments.

4. The composition of claim 3, wherein the at least two different hyperimmune serum-reactive antigen fragments are both bind to anti-*S.agalactiae* serum.

5. The composition of claim 1, further comprising an immunostimulatory substance.

6. The composition of claim 5, wherein the immunostimulatory substance is a polycationic polymer, an immunostimulatory non-methylated deoxynucleotide (ODN), a peptide containing at least two LysLeuLys motifs alum, or a Freund's complete or incomplete adjuvant.

7. A pharmaceutical composition comprising:
(a) an isolated hyperimmune serum-reactive antigen fragment consisting of an amino acid sequence of 399-417, 503-519, 544-563, 489-556, 386-458, or 458-624 of SEQ ID NO:364; and
(b) an immunostimulatory substance.

* * * * *

UNITED STATES PATENT AND TRADEMARK OFFICE
CERTIFICATE OF CORRECTION

PATENT NO. : 7,438,912 B2  
APPLICATION NO. : 10/556060  
DATED : October 21, 2008  
INVENTOR(S) : Andreas Meinke et al.

It is certified that error appears in the above-identified patent and that said Letters Patent is hereby corrected as shown below:

In claim 2, column 115, line 52, insert hyphen between "anti-*S.agalactiae*" and "serum".

In claim 4, column 115, line 58, delete "are".

In claim 4, column 115, line 59, insert hyphen between "anti-*S.agalactiae*" and "serum".

In claim 6, column 116, line 51, insert comma between "motifs" and "alum".

In claim 7, column 116, line 53, delete "pharmaceutical".

Signed and Sealed this

Sixth Day of January, 2009

JON W. DUDAS  
*Director of the United States Patent and Trademark Office*